United States Patent
Xavier et al.

(10) Patent No.: US 12,374,423 B2
(45) Date of Patent: Jul. 29, 2025

(54) SYSTEMS AND METHODS FOR MHC CLASS II EPITOPE PREDICTION

(71) Applicants: THE BROAD INSTITUTE, INC., Cambridge, MA (US); THE GENERAL HOSPITAL CORPORATION, Boston, MA (US)

(72) Inventors: Ramnik Xavier, Boston, MA (US); Daniel B. Graham, Cambridge, MA (US); Chengwei Luo, Cambridge, MA (US)

(73) Assignees: THE BROAD INSTITUTE, INC, Cambridge, MA (US); THE GENERAL HOSPTIAL CORPORATION, Boston, MA (US)

( * ) Notice: Subject to any disclaimer, the term of this patent is extended or adjusted under 35 U.S.C. 154(b) by 1447 days.

(21) Appl. No.: 16/627,193

(22) PCT Filed: Jun. 27, 2018

(86) PCT No.: PCT/US2018/039843
§ 371 (c)(1),
(2) Date: Dec. 27, 2019

(87) PCT Pub. No.: WO2019/006022
PCT Pub. Date: Jan. 3, 2019

(65) Prior Publication Data
US 2022/0293215 A1  Sep. 15, 2022

Related U.S. Application Data

(60) Provisional application No. 62/525,673, filed on Jun. 27, 2017.

(51) Int. Cl.
| | |
|---|---|
| *G16B 20/30* | (2019.01) |
| *A61K 39/00* | (2006.01) |
| *A61K 39/02* | (2006.01) |
| *C07K 14/195* | (2006.01) |
| *G16B 15/30* | (2019.01) |
| *G16B 35/20* | (2019.01) |
| *G16B 40/20* | (2019.01) |

(52) U.S. Cl.
CPC .......... *G16B 20/30* (2019.02); *A61K 39/0208* (2013.01); *C07K 14/195* (2013.01); *G16B 15/30* (2019.02); *G16B 35/20* (2019.02); *G16B 40/20* (2019.02); *A61K 2039/57* (2013.01); *A61K 2039/605* (2013.01)

(58) Field of Classification Search
None
See application file for complete search history.

(56) References Cited

U.S. PATENT DOCUMENTS

| | | |
|---|---|---|
| 5,468,481 A | 11/1995 | Sharma |
| 5,849,589 A | 12/1998 | Tedder et al. |
| 6,379,970 B1 | 4/2002 | Liebler et al. |
| 6,406,705 B1 | 6/2002 | Davis et al. |
| 7,608,279 B2 | 10/2009 | Parisot et al. |
| 2012/0087862 A1 | 4/2012 | Hood |
| 2015/0301044 A1 | 10/2015 | Klein |

FOREIGN PATENT DOCUMENTS

| | | |
|---|---|---|
| WO | WO-2014/210353 A2 | 12/2014 |
| WO | WO-2016/040476 A1 | 3/2016 |
| WO | WO-2016/100977 A1 | 6/2016 |
| WO | WO-2016/168584 A1 | 10/2016 |
| WO | 2017106638 A1 | 6/2017 |
| WO | WO-2017/164936 A1 | 9/2017 |
| WO | 2019006022 A1 | 1/2019 |

OTHER PUBLICATIONS

Gubin et al Science Oct. 5, 2015 vo; 350 iss6257 p. 158-159.*
Andreatta, et al., "Characterizing the Binding Motifs of 11 Common Human HLA-DP and HLA-DQ Molecules using NNAlign", Immunology, vol. 136, No. 3, Jul. 2012, 306-311.
Andreatta, et al., "NNAlign: A Web-Based Prediction Method Allowing Non-Expert End-User Discovery of Sequence Motifs in Quantitative Peptide Data", PLoS One , vol. 6, Issue 11, Nov. 2011, 11 pages.
Chicz, et al., "Predominant Naturally Processed Peptides Bound to HLA-DR1 are Derived from MHC-related Molecules and are Heterogeneous in Size", Nature, vol. 358, No. 6389, Aug. 27, 1992, 764-768.
Chicz, et al., "Specificity and Promiscuity among Naturally Processed Peptides Bound to HLA-DR Alleles", Journal of Experimental Medicine, vol. 178, No. 1, Jul. 1993, 27-47.
Depontieu, et al., "Identification of Tumor-Associated, MHC Class II-restricted Phosphopeptides as Targets for Immunotherapy", Proceedings of the National Academy of Sciences of the United States of America, vol. 106, No. 29, Jul. 21, 2009, 12073-12078.
Hunt, et al., "Peptides Presented to the Immune System by the Murine Class II Major Histocompatibility Complex Molecule I-Ad", Science, vol. 256, No. 5065, Jun. 26, 1992, 1817-1820.
Kim, et al., "Determinants of Immunodominance for CD4 T cells", Current Opinion in Immunology, vol. 34, Jun. 2015, 13 pages.
Lippolis, et al., "Analysis of MHC Class II Antigen Processing by Quantitation of Peptides That Constitute Nested Sets", Journal of Immunology, vol. 169, No. 9, Nov. 2002, 5089-5097.
Mommen, et al., "Sampling from the Proteome to the Human Leukocyte Antigen-DR (HLA-DR) Ligandome Proceeds Via High Specificity", Molecular & Cellular Proteomics, vol. 15, No. 4, Apr. 2016, 1412-1423.

(Continued)

*Primary Examiner* — Joseph Woitach
(74) *Attorney, Agent, or Firm* — Foley & Lardner LLP; Sunit Talapatra

(57) ABSTRACT

A system and method for prediction of immunodominant epitopes is provided herein. MHCII peptidomics was used to discover complex bacterial epitopes and host antigen processing pathways. Novel insights into the features of antigenicity are leveraged to build an algorithm for prediction of immunodominant epitopes. Use of immunodominant epitopes is described.

18 Claims, 29 Drawing Sheets
Specification includes a Sequence Listing.

(56) References Cited

OTHER PUBLICATIONS

Nelson, et al., "Identification of the Naturally Processed Form of Hen Egg White Lysozyme Bound to the Murine Major Histocompatibility Complex Class II Molecule I-Ak", Proceedings of the National Academy of Sciences of the United States of America, vol. 89, No. 16, Aug. 1992, 7380-7383.
Rudensky, et al., "Sequence Analysis of Peptides Bound to MHC Class II Molecules", Nature, vol. 353, No. 6345, Oct. 17, 1991, 622-627.
Seamons, et al., "Competition Between two MHC Binding Registers in a Single Peptide Processed From Myelin Basic Protein Influences Tolerance and Susceptibility to Autoimmunity", Journal of Experimental Medicine, vol. 197, No. 10, May 19, 2003, 1391-1397.
Sette, "Invariant Chain Peptides in Most HLA-DR Molecules of an Antigen-processing Mutant", Science, vol. 258, No. 5089, Dec. 11, 1992, 1801-1804.
Sofron, et al., "High-resolution Analysis of the Murine MHC Class II Immunopeptidome", European Journal of Immunology, vol. 46, No. 2, Feb. 2016, 319-328.
Suri, et al., "First Signature of Islet β-Cell-Derived Naturally Processed Peptides Selected by Diabetogenic Class II MHC Molecules", Journal of Immunology, vol. 180, No. 6, Mar. 15, 2008, 3849-3856.
BPS Bioscience, IL-2-Luciferase Reporter (Luc)—Jurkat Cell Line, May 16, 2017, https://web.archive.org/web/20170516091246/http://lbpsbioscience.com/il2-jurkat-cell-line-60481, 1 page.
Andreatta, et al., "Accurate pan-specific prediction of peptide-MHC class II binding affinity with improved binding core identification", Immunogenetics, Nov. 2015, vol. 67, 641-650.
Jeannin, et al., "Outer membrane protein A (OmpA): a new pathogen-associated molecular pattern that interacts with antigen presenting cells-impact on vaccine strategies.", Vaccine 19, Dec. 2002, vol. 20 Suppl 4:A23-A27, 1 page.
Redmond, et al., "Single-cell TCRseq: paired recovery of entire T-cell alpha and beta chain transcripts in T-cell receptors from single-cell RNAseq", Genome Med Jul. 27, 2016 vol. 8 No. 80, pp. 1-12.
Sun, et al., "Listeriolysin O as a strong immunogenic molecule for the development of new anti-tumor vaccines", Human Vaccines & Immunotherapeutics, May 2013, 9:5, 1058-1068.
Young, "International Search Report and Written Opinion of PCT/US2018/039843", 18 pages.
Zhu, et al., "Crystal structure of MHC class II I-Ab in complex with a human CLIP peptide: prediction of an I-Ab peptide-binding motif", J Mot Biol Feb. 28, 2003 vol. 32G No. 4 pp. 1157-1174., 2 pages.
Alipanahi et al., "Predicting the sequence specificities of DNA- and RNA-binding proteins by deep learning," Nature Biotechnology, Aug. 2015, vol. 33, No. 8 (pp. 831-838).
Allison et al., "Immunological Adjuvants and Their Mode of Action, Developments in Biological Standardization," Vaccines, New Approaches to Immunological Problems, 1992, Chapter 19 (pp. 431-449).
Anders et al., "HTSeq—a Python framework to work with high-throughput sequencing data," Bioinformatics, 2015, vol. 31, No. 2 (pp. 166-169).
Appleby et al. "New technologies for ultra-high throughput genotyping in plants", Methods in Molecular Biology, Plant Genomics, vol. 513 (pp. 19-39).
Arunachalam et al., "Enzymatic reduction of disulfide bonds in lysosomes: characterization of a gamma-interferon-inducible lysosomal thiol reductase (GILT)," Proceedings of the National Academy of Sciences, USA, Jan. 18, 2000, vol. 97, No. 2 (pp. 745-750).
Aucouturier et al., "Adjuvants designed for veterinary and human vaccines," Vaccine, Mar. 21, 2001, vol. 19 (pp. 2666-2672).
Babbitt et al., "Binding of immunogenic peptides to Ia histocompatibility molecules," Nature, 1985, vol. 317 (359-361).
Bhardwaj et al., "TLR Agonists: Are They Good Adjuvants?" Cancer Journal, 2010. vol. 16, No. 4 (pp. 382-391).
Binder et al., "Compartments: unification and visualization of protein subcellular localization evidence," Database (Oxford), 2014, bau012 (9 pages).
Bland et al., "Statistical methods for assessing agreement between two methods of clinical measurement," The Lancet, Feb. 8, 1986, vol. 327, No. 8476 (pp. 307-310).
Calis et al., "Characterizing immune repertoires by high throughput sequencing: strategies and applications," Trends in Immunology, Dec. 2014, vol. 35, No. 12 (pp. 581-590).
Cao et al., "Comprehensive single cell transcriptional profiling of a multicellular organism by combinatorial indexing," bioRxiv preprint first posted online Feb. 2, 2017 (35 pages).
Cao et al., "Comprehensive single-cell transcriptional profiling of a multicellular organism," Science, Aug. 18, 2017, vol. 357, No. 6352 (pp. 661-667).
Carneiro et al., "Pacific biosciences sequencing technology for genotyping and variation discovery in human data," BMC Genomics, Aug. 5, 2012, vol. 13, No. 375 (7 pages).
Caskey et al., "Synthetic double-stranded RNA induces innate immune responses similar to a live viral vaccine in humans," The Journal of Experimental Medicine, Nov. 21, 2011, vol. 208, No. 12 (pp. 2357-2366).
Chatterjee et al., "Intracellular gene expression profile of Listeria monocytogenes," Infection and Immunity, Feb. 2006, vol. 74, No. 2 (pp. 1323-1338).
Christmann et al., "Human seroreactivity to gut microbiota antigens," Journal of Allergy and Clinical Immunology, Nov. 2015, vol. 136, No. 5 (pp. 1378-1386).
Conway et al., "ATG5 regulates plasma cell differentiation," Autophagy, Apr. 2013, vol. 9, No. 4 (pp. 528-537).
Conway et al., "Atg16l1 is required for autophagy in intestinal epithelial cells and protection of mice from Salmonella infection," Gastroenterology, Dec. 2013, vol. 145, No. 6 (pp. 1347-1357).
Corpet et al., "Multiple sequence alignment with hierarchical clustering," Nucleic Acids Res. Nov. 25, 1988, vol. 16, No. 22 (pp. 10881-10890).
Cresswell et al., "Thiol oxidation and reduction in MHC-restricted antigen processing and presentation," Immunologic Research, 1999, vol. 19 (pp. 191-200).
Crooks et al., "WebLogo: a sequence logo generator," Genome Research, Jun. 2004, vol. 14, No. 6 (pp. 1188-1190).
Dongre et al., "In vivo MHC Class II Presentation of Cytosolic Proteins Revealed by Rapid Automated Tandem Mass Spectrometry and Functional Analyses," European Journal of Immunology, May 2001, vol. 31, No. 5 (pp. 1485-1494).
Dupuis et al., "Dendritic Cells Internalize Vaccine Adjuvant after Intramuscular Injection," Cellular Immunology, May 25, 1998, vol. 186, No. 1 (pp. 18-27).
Eddy, S. R., "Accelerated Profile HMM Searches," PLoS Computational Biology, Oct. 2011, vol. 7, No. 10 (16 pages).
Erlich, H., "HLA typing using next generation sequencing: An overview," Human Immunology, Dec. 2015, vol. 76, No. 12 (pp. 887-890).
Finn et al., "The Pfam protein families database: towards a more sustainable future," Nucleic Acids Research, Jan. 2016, vol. 44, D279-285 (7 pages).
Gabrilovich et al., "IL-12 and mutant P53 peptide-pulsed dendritic cells for the specific immunotherapy of cancer," Journal of Immunotherapy with Emphasis on Tumor Immunology: Official Journal of the Society for Biological Therapy, Nov. 1, 1996, vol. 19, No. 6 (pp. 414-418).
Gierahn et al., "Seq-Well: Portable, Low-Cost RNA Sequencing of Single Cells at High Throughput," Nature Methods, Apr. 2017, vol. 14, No. 4 (8 pages).
Habib et al., "Div-Seq: Single-nucleus RNA-Seq reveals dynamics of rare adult newborn neurons," Science, Aug. 26, 2016, vol. 353, No. 6302 (pp. 925-928).
Habib et al., "Massively parallel single-nucleus RNA-seq with DroNc-seq," Nature Methods, Oct. 2017, vol. 14, No. 10 (pp. 955-958).

(56) References Cited

OTHER PUBLICATIONS

Hall et al., "Human genetic variation and the gut microbiome in disease," Nature Review Genetics, 2017, vol. 18 (pp. 690-699).
Hara et al., "Suppression of basal autophagy in neural cells causes neurodegenerative disease in mice," Nature, 2006, vol. 441 (pp. 885-889).
Hashimshony, et al., "CEL-Seq: Single-Cell RNA-Seq by Multiplexed Linear Amplification," Cell Reports, 2012, vol. 2, No., 3 (pp. 666-673).
Head et al., "Library construction for next-generation sequencing: Overviews and challenges," Biotechniques, 2014, vol. 56, No. 2 (pp. 61-77).
Heng et al., "The Immunological Genome Project: networks of gene expression in immune cells," Nature Immunology, Oct. 2008, vol. 9, No. 10 (pp. 1091-1094).
Hsieh et al., "A role for cathepsin L and cathepsin S in peptide generation for MHC class II presentation," The Journal of Immunology, 2002, vol. 168 (pp. 2618-2625).
Hsing et al., "The lysosomal cysteine proteases in MHC class II antigen presentation," Immunological Reviews, Sep. 23, 2005, vol. 207, No. 1 (pp. 229-241).
Imelfort et al., "De novo sequencing of plant genomes using second-generation technologies," Briefings in Bioinformatics, 2009, vol. 10, No. 6 (pp. 609-618).
Islam, et al., "Characterization of the single-cell transcriptional landscape by highly multiplex RNA-seq," Genome Research, 2011, vol. 21, No. 7 (pp. 1160-1167).
Janeway et al., "Monoclonal antibodies specific for Ia glycoproteins raised by immunization with activated T cells: possible role of T cellbound Ia antigens as targets of immunoregulatory T cells," Journal of Immunology, Feb. 1984, vol. 132, No. 2 (pp. 662-667).
Kalisky et al., "Genomic Analysis at the Single-Cell Level," Annual Review of Genetics, 2011, vol. 45 (pp. 431-445).
Kalisky et al., "Single-cell genomics," Nature Methods, Apr. 2011, vol. 8, No. 4 (pp. 311-314).
Kim et al., "TopHat2: accurate alignment of transcriptomes in the presence of insertions, deletions and gene fusions," Genome Biology, 2013, vol. 14, R36 (13 pages).
Klein et al., "Droplet barcoding for single-cell transcriptomics applied to embryonic stem cells," Cell, May 21, 2015, vol. 161 (pp. 1187-1201).
Krieg, A.M., "Therapeutic potential of Toll-like receptor 9 activation," Nature Reviews, Drug Discovery, Jun. 1, 2006, vol. 5, No. 6 (pp. 471-484).
Kronke et al., "Lenalidomide induces ubiquitination and degradation of CKIalpha in del(5q) MDS," Nature, Jul. 9, 2015, vol. 523 (pp. 183-188).
Lassen et al., "Atg16L1 T300A variant decreases selective autophagy resulting in altered cytokine signaling and decreased antibacterial defense," Proceedings of the National Academy of Sciences, USA, May 27, 2014, vol. 111, No. 21 (pp. 7741-7746).
Li et al., "Fast and accurate short read alignment with Burrows-Wheeler transform," Bioinformatics, 2009, vol. 25, No. 14 (pp. 1754-1760).
Liu et al., "Alternate interactions define the binding of peptides to the MHC molecule IA(b)," Proceedings of the National Academy of Sciences, USA, Jun. 25, 2002, vol. 99, No. 13 (pp. 8820-8825).
Macosko et al., "Highly Parallel Genome-wide Expression Profiling of Individual Cells Using Nanoliter Droplets," Cell, May 21, 2015, vol. 161 (pp. 1202-1214).
Mantere et al., "Targeted Next-Generation Sequencing Identifies a Recurrent Mutation in MCPH1 Associating with Hereditary Breast Cancer Susceptibility," PLOS Genetics, Jan. 28, 2016 (14 pages).
Marchler-Bauer et al., "CDD: NCBI's conserved domain database," Nucleic Acids Research, Jan. 2015, vol. 43, D222-6 (5 pages).
Margulies et al. "Genome sequencing in microfabricated high-density picolitre reactors", Nature, Jul. 31, 2005, vol. 437 (pp. 376-380).
Mathe et al., "Current methods of gene prediction, their strengths and weaknesses," Nucleic Acids Research, Oct. 1, 2002, vol. 30, No. 19 (pp. 4103-4117).
McDavid et al., "Modeling bi-modality improves characterization of cell cycle on gene expression in single cells," PLoS Computational Biology, Jul. 17, 2014, vol. 10, No. 7 (10 pages).
Melief et al., "Immunotherapy of established (pre)malignant disease by synthetic long peptide vaccines," Nature Reviews Cancer, May 2008 vol. 8, No. 5 (pp. 351-360).
Merrifield, "Solid Phase Peptide Synthesis. I. The synthesis of a Tetrapeptide," Journal of the American Chemical Society, 1963, vol. 85, No. 14 (pp. 2149-2154).
Mertins et al., "Ischemia in tumors induces early and sustained phosphorylation changes in stress kinase pathways but does not affect global protein levels," Molecular & Cellular Proteomics, Jul. 2014, vol. 13, No. 7 (pp. 1690-1704).
Miyazaki et al., "Mice lacking H2-M complexes, enigmatic elements of the MHC class II peptide-loading pathway," Cell, Feb. 23, 1996, vol. 84 (pp. 531-541).
Morozova et al., "Applications of next-generation sequencing technologies in functional genomics," Genomics, 2008. vol. 92 (pp. 255-264).
Ng et al., "Targeted capture and massively parallel sequencing of 12 human exomes", Nature, Sep. 10, 2009, vol. 461 (pp. 272-276).
Ormerod et al., "Genomic characterization of the 1 uncultured Bacteroidales family S24-7 inhabiting the guts of homeothermic animals," Microbiome, Jul. 7, 2016, vol. 4, No. 36 (17 pages).
Palm et al., "Immune-microbiota interactions in health and disease," Clinical Immunology, Aug. 2015, vol. 159, No. 2 (pp. 122-127).
Picelli et al. "Full-length RNA-seq from single cells using Smart-seq2," Nature Protocols, Jan. 2014, vol. 9, No. 1 (pp. 171-181).
Ramskold et al., "Full-length mRNA-Seq from single-cell levels of RNA and individual circulating tumor cells," Nature Biotechnology, Aug. 2012, vol. 30, No. 8 (777-782).
Rappsilber et al. "Protocol for micro-purification, enrichment, prefractionation and storage of peptides for proteomics using StageTips," Nature Protocols, 2007, vol. 2 No. 8 (pp. 1896-1906).
Robinson et al., "edgeR: A Bioconductor Package for Differential Expression Analysis of Digital Gene Expression Data," Bioinformatics, Jan. 1, 2010, vol. 26, No. 1 (pp. 139-140).
Ronaghi et al., "Real-time DNA sequencing using detection of pyrophosphate release," Analytical Biochemistry, 1996, vol. 242, Article 0432 (pp. 84-89).
Rosati et al., "Overview of methodologies for T-cell receptor repertoire analysis," BMC Biotechnoly, Jul. 10, 2017, vol. 17, No. 61 (1-16).
Rosenberg et al., "Scaling single cell transcriptomics through split pool barcoding," bioRxiv preprint first posted online Feb. 2, 2017 (13 pages).
Sabado et al., "Preparation of tumor antigen-loaded mature dendritic cells for immunotherapy," Journal of Visualized Experiments, Aug. 1, 2013, vol. 78 (8 pages).
Scallan et al., "Foodborne illness acquired in the United States—major pathogens," Emerging Infectious Diseases, Jan. 2011, vol. 17, No. 1 (pp. 7-15).
Schindelin, et al., "Fiji—an Open Source platform for biological image analysis," Nature Methods, 2012, vol. 9, No. 7 (pp. 676-682).
Schulze et al., "The mechanism of HLA-DM induced peptide exchange in the MHC class II antigen presentation pathway," Current Opinion in Immunology, Feb. 2012, vol. 24, No. 1 (pp. 105-111).
Shendure et al., "Accurate Multiplex Polony Sequencing of an Evolved Bacterial Genome," Science, Sep. 9, 2005, vol. 309 (pp. 1728-1732).
Smyth, "Linear models and empirical bayes methods for assessing differential expression in microarray experiments," Stat Appl Genet Mol Biol., 2004, vol. 3, Issue 1, Article 3 (28 pages).
Speiser et al., "Molecularly defined vaccines for cancer immunotherapy, and protective T cell immunity," Seminars in Immunology, Jun. 2010, vol. 22, No. 3 (pp. 144-154).
Stahl-Hennig et al., "Synthetic double-stranded RNAs are adjuvants for the induction of T helper 1 and humoral immune responses to

(56) References Cited

OTHER PUBLICATIONS human papillomavirus in rhesus macaques," PLoS Pathogens, Apr. 10, 2009, vol. 5, No. 4 (15 pages).
Stern et al., "Crystal structure of the human class II MHC protein HLA-DRI complexed with an influenza virus peptide," Nature, Mar. 17, 1994, vol. 368 (pp. 215-221).
Stoll et al., "Altered microbiota associated with abnormal humoral immune responses to commensal organisms in enthesitis-related arthritis," Arthritis Research & Therapy, Nov. 30, 2014, vol. 16 (10 pages).
Swiech et al., "In vivo interrogation of gene function in the mammalian brain using CRISPR-Cas9," Nature Biotechnology, 2014, vol. 33 (pp. 102-106) [Including Supplemental information, 4 pages].
Tang et al., "mRNA-Seq whole-transcriptome analysis of a single cell," Nature Methods, May 2009, vol. 6, No. 5 (pp. 377-382).
Tang et al., "RNA-Seq analysis to capture the transcriptome landscape of a single cell," Nature Protocols, Mar. 2010, vol. 5, No. 3 (pp. 516-535).
Thibodeau et al., "Targeting the MHC Class II antigen presentation pathway in cancer immunotherapy," Oncoimmunology, Sep. 1, 2012, vol. 1, No. 6 (pp. 908-916).
Tusnady et al., "Principles governing amino acid composition of integral membrane proteins: application to topology prediction," Journal of Molecular Biology, Oct. 23, 1998, vol. 283 (pp. 489-506).
Vitak et al., "Sequencing thousands of single-cell genomes with combinatorial indexing," Nature Methods, Jan. 2017, vol. 14, No. 3 (pp. 302-308).
Wang et al., "A systematic assessment of MHC class II peptide binding predictions and evaluation of a consensus approach," PLoS Computational Biology, Apr. 4, 2008, vol. 4, No. 4 (10 pages).
Weber et al., "Distinct CD4+ helper T cells involved in primary and secondary responses to infection," Proceedings of the National Academy of Sciences, USA, May 29, 2012, vol. 109, No. 24 (pp. 9511-9516).
Yu et al., "PSORTb 3.0: improved protein subcellular localization prediction with refined localization subcategories and predictive capabilities for all prokaryotes," Bioinformatics, Jul. 2010, vol. 26, No. 13 (pp. 1608-1615).
Zeng et al., "Gut Microbiota-Induced Immunoglobulin G Controls Systemic Infection by Symbiotic Bacteria and Pathogens," Immunity, Mar. 15, 2016, vol. 44, No. 33 (pp. 647-658).
Zheng et al. "Haplotyping germline and cancer genomes with high-throughput linked-read sequencing" Nature Biotechnology, Feb. 1, 2016, vol. 34, No. 3 (pp. 303-311) [with Supplemental Material].
Zheng et al., "Massively parallel digital transcriptional profiling of single cells," Nature Communications, Jan. 16, 2017, vol. 8, No. 14049 (12 pages).
Zilionis et al., "Single-cell barcoding and sequencing using droplet microfluidics," Nature Protocols, 2017, vol. 12, No. 1 (pp. 44-73).
Xu et al., "Identification of cell types from single-cell transcriptomes using a novel clustering method," Bioinformatics, Feb. 11, 2015, vol. 31, No. 12 (pp. 1974-1980).

\* cited by examiner

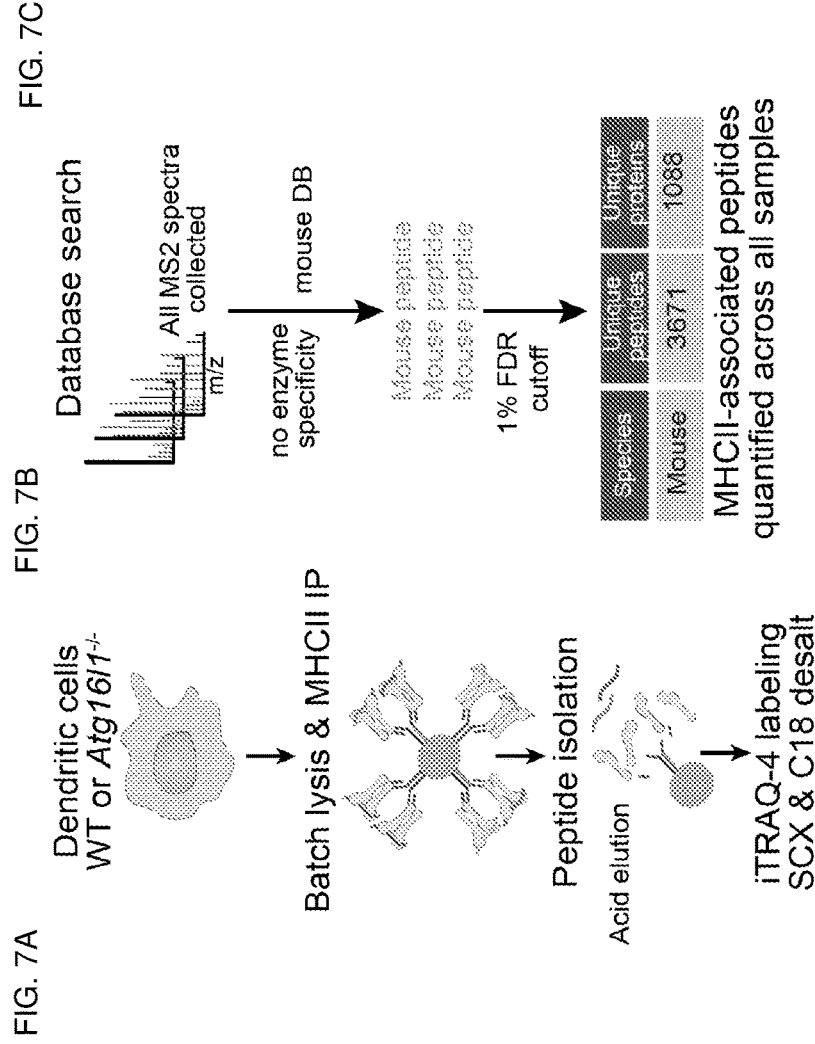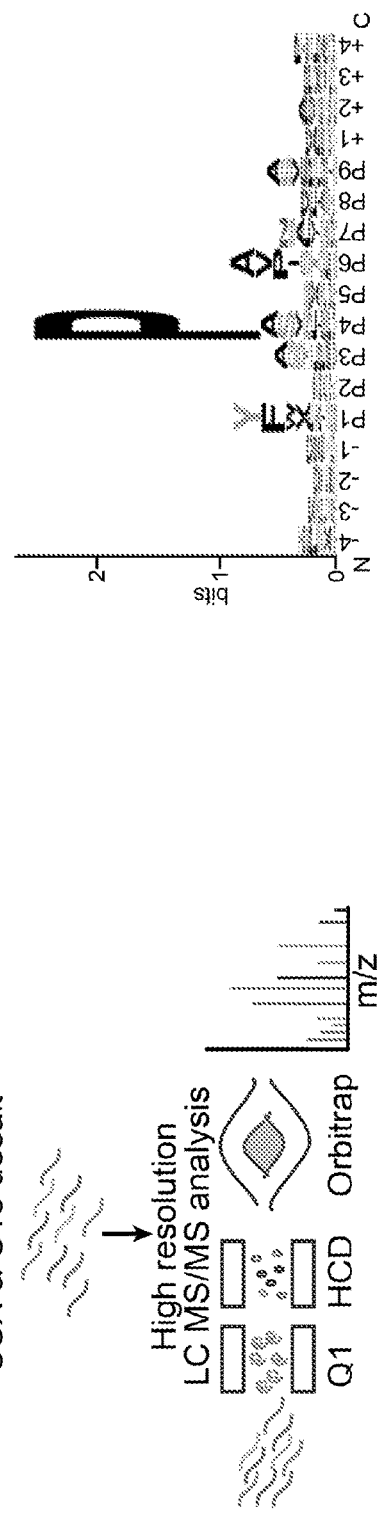

| | | |
|---|---|---|
| SEQ ID NO: 15069 | EDRRYNPPIIHQ | C-C motif chemokine 6 |
| SEQ ID NO: 15070 | GIKADKADKAAASGPASASAP | Integral membrane protein 2C |
| SEQ ID NO: 15071 | FVnYSNAVTLHLGNn | SLIT and NTRK-like protein 2 |
| SEQ ID NO: 15072 | EmEKEDRRYNPPIIHQGFQ | C-C motif chemokine 6 |
| SEQ ID NO: 15073 | EPRVLPYHPAQPGQAT | Chondroitin sulfate synthase 2 |
| SEQ ID NO: 15074 | GRRTDWEAPTGQPSAPGP | TBC1 domain family member 1 |
| SEQ ID NO: 15075 | DKNGNPLNSVFVAPAVTPVKGVL | Acid sphingomyelinase-like phosphodiesterase 3a |
| SEQ ID NO: 15076 | GDLEYQMSTTARAKR | Junction plakoglobin |
| SEQ ID NO: 15077 | ATPRDYYFALAHTVRDH | "Glycogen phosphorylase, liver form" |
| SEQ ID NO: 15078 | SSIASFKDPKISTSLPV | Plastin-2 |
| SEQ ID NO: 15079 | LPQDPTFHTPLDLYAYAR | Galectin-3-binding protein |
| SEQ ID NO: 15080 | DVDFDFAGPAIHGSAV | Voltage-dependent anion-selective channel protein 2 |
| SEQ ID NO: 15081 | GYPTAYPAAAPAYNPS | Protein FAM168A |
| SEQ ID NO: 15082 | DSPDVVYSPETIEARYE | Inositol-3-phosphate synthase 1 |
| SEQ ID NO: 15083 | TPDPNTAYASYPSASVEN | Synaptogyrin-2 |
| SEQ ID NO: 15084 | ESPDQWSSSSPHSASDW | Neurogenic locus notch homolog protein 2 |
| SEQ ID NO: 15085 | VDFDFAGPAIHGSAV | Voltage-dependent anion-selective channel protein 2 |
| SEQ ID NO: 15086 | DPTPDPNTAYASYPSASVEN | Synaptogyrin-2 |
| SEQ ID NO: 15087 | KLLEAKGPVTDVAYSHD | WD repeat-containing protein 1 |
| SEQ ID NO: 15088 | APVEGASPTSISAVDG | "Class II histocompatibility antigen, M alpha chain" |
| SEQ ID NO: 15089 | KKELEEQLGPVAEETR | Apolipoprotein E |
| SEQ ID NO: 15090 | LVEKIF | BPI fold-containing family B member 4 |
| SEQ ID NO: 15091 | SSVAFIKPGVNKAEVT | SLAM family member 5 |
| SEQ ID NO: 15092 | SPDQWSSSSPHSASDW | Neurogenic locus notch homolog protein 2 |
| SEQ ID NO: 15093 | APETRSQVTPSVPSEALDD | Low-density lipoprotein receptor-related protein 10 |
| SEQ ID NO: 15094 | YnIPFTEKnILYSAFLWRT | Protein Vmn2r60 |
| SEQ ID NO: 15095 | SPESPDQWSSSSPHSASDW | Neurogenic locus notch homolog protein 2 |
| SEQ ID NO: 15096 | TPSPESPDQWSSSSPHSASDW | Neurogenic locus notch homolog protein 2 |
| SEQ ID NO: 15097 | DGDSYRSPWSNKYDPP | F-actin-capping protein subunit beta |
| SEQ ID NO: 15098 | IGNERFRCPEAIFQPS | Beta-actin-like protein 2 |
| SEQ ID NO: 15099 | DGDSYRSPWSNKYDPPL | F-actin-capping protein subunit beta |
| SEQ ID NO: 15100 | RKIVYEGPELNHAFG | Prolow-density lipoprotein receptor-related protein 1 |

FIG. 8E (Cont.)

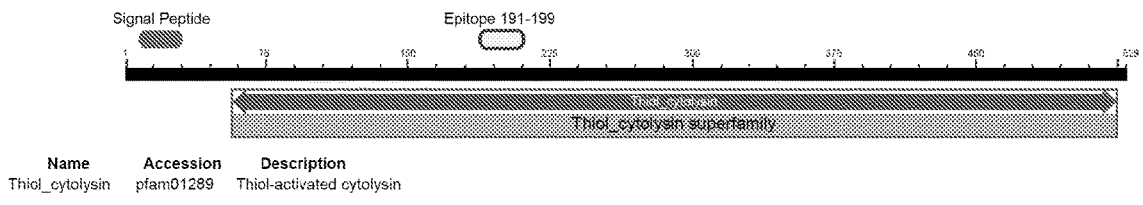
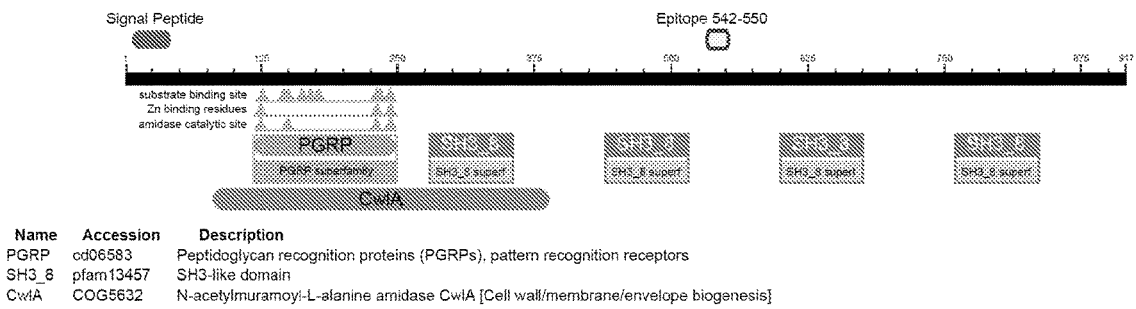
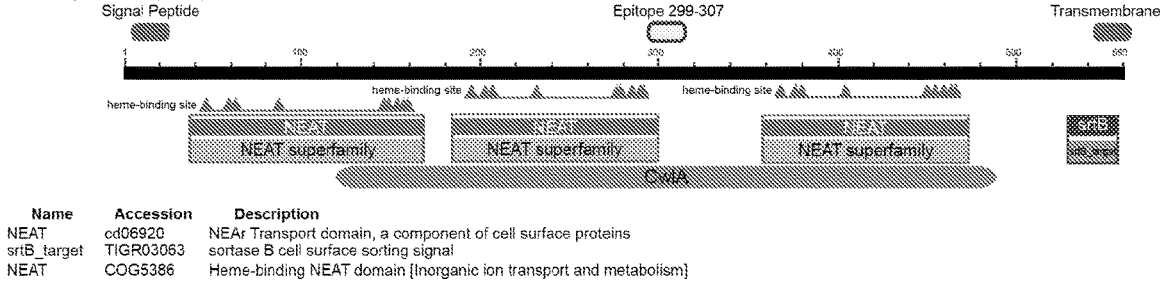
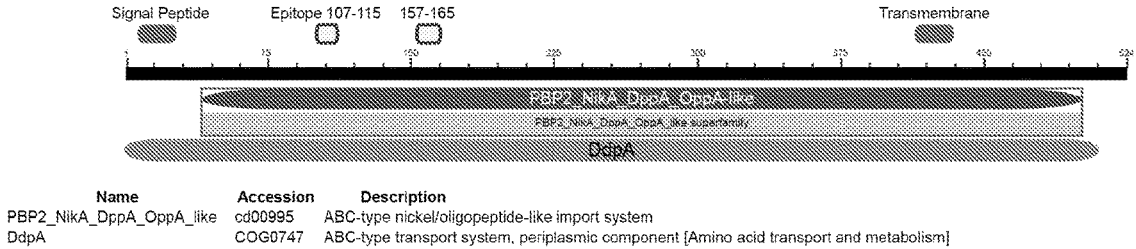
FIG. 10A

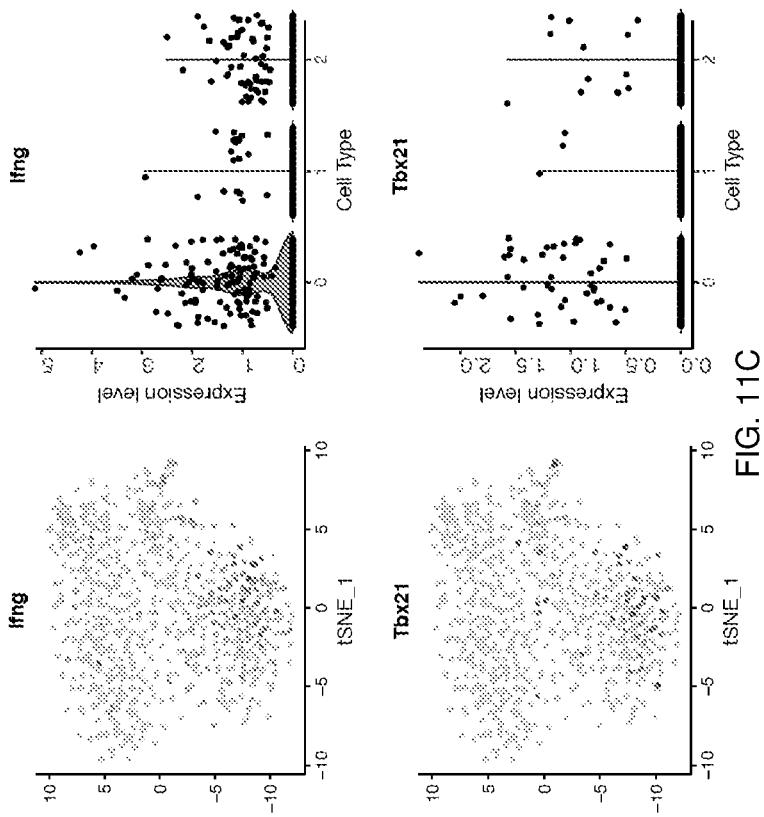
FIG. 11B
FIG. 11C
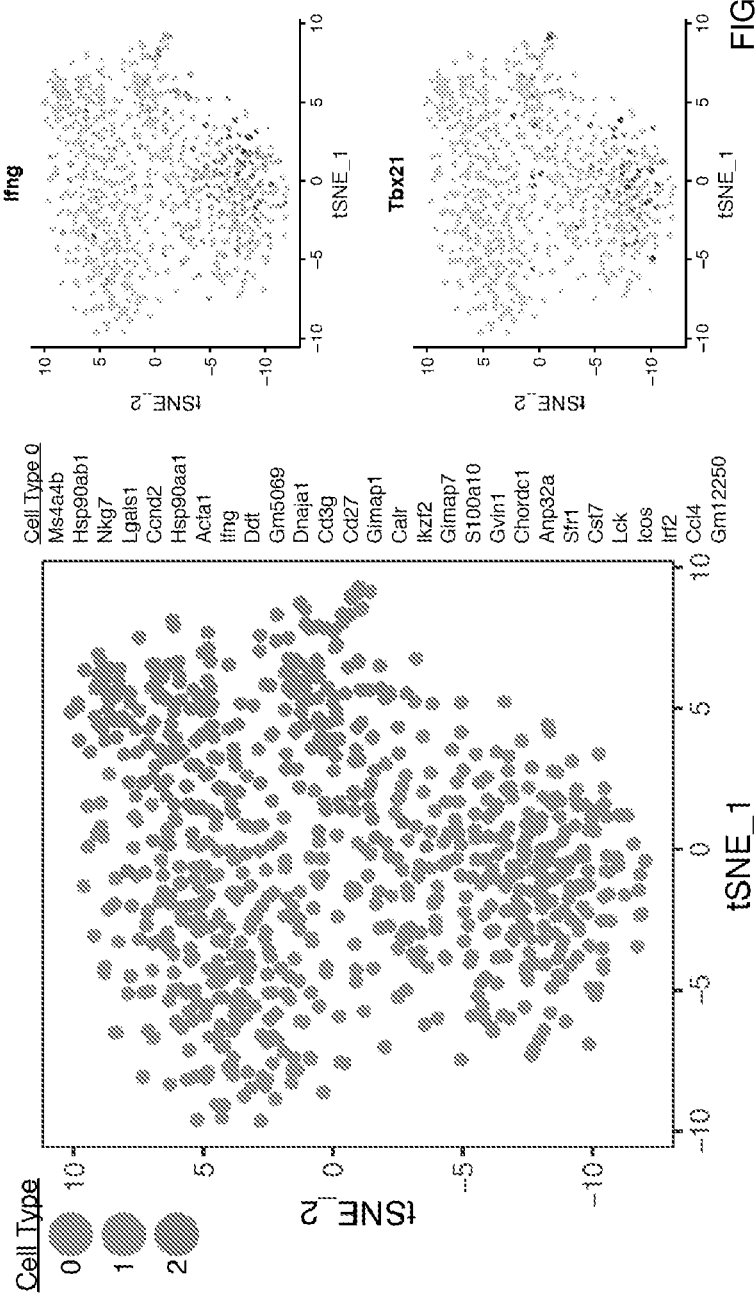
FIG. 11A

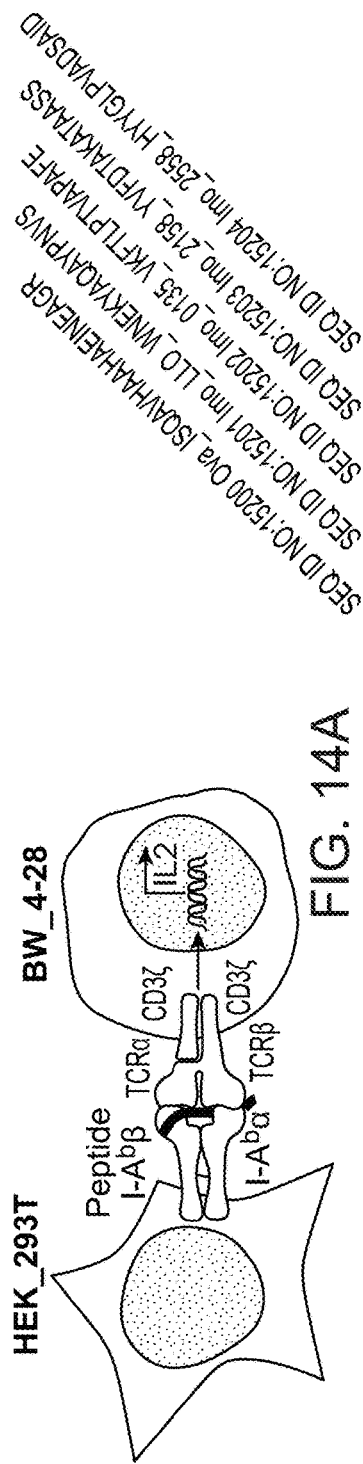
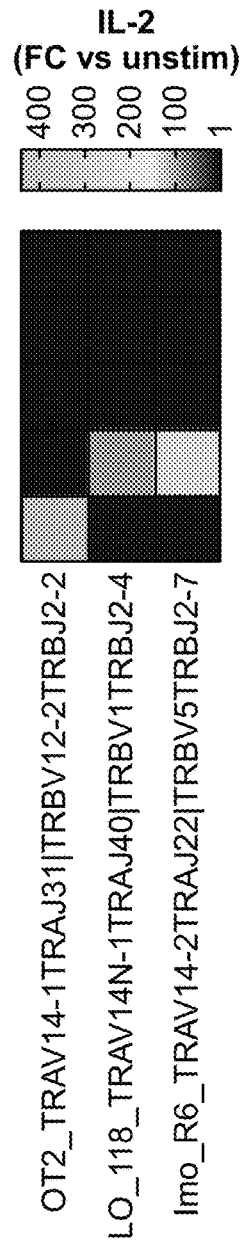
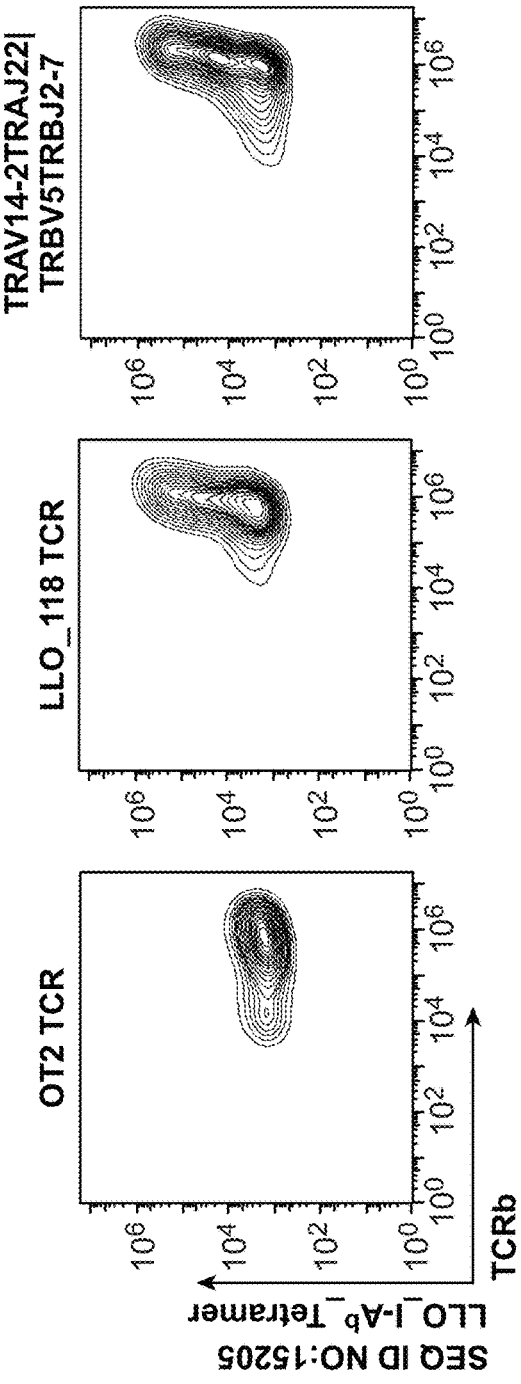
FIG. 14A
FIG. 14B
FIG. 14C
SEQ ID NO:15200 Ova_ISQAVHAAHAEINEAGR
SEQ ID NO:15201 lmo_0135_WNEKYAQAYPNVS
SEQ ID NO:15202 lmo_2158_VKFTLPTYAPAFE
SEQ ID NO:15203 lmo_15204 lmo_2558_HYFDTAKATAASS
SEQ ID NO:15204 YYFGLPVADSAID

**Many SusC-like genes in the *bacteroidales* genome (including human-associated strains)**

Muribaculum intestinale YL27
SusC/RagA TonB genes

Mouse I-A$^b$ (human orthologue HLA-DQ) epitopes in conserved region

*Hot Spot*

| gene | | 301 | | | | | | 350 351 | | | | 400 |
|------|---|-----|---|---|---|---|---|---------|---|---|---|-----|
| RS08305 | SEQ ID NO: 15219 | VDGVPITSGD | AGTGSGASFS | NSDAPIDFGN | GASEINPEDV | ESVTVLKGPA | ATALYGSRAA | NGAIVITTKS | GKA...... | EKGVGVTLNS | SITWEKAGYY |
| RS06325 | SEQ ID NO: 15220 | VDGIP..... | .......... | .......... | ......YDG | GLMSINPQDV | QSISVLKDAS | ATALYGSRAA | NGVILVTTKR | GQAGPAKVTL | EARWGANSRQ VSDYETVDDI |
| RS02245 | SEQ ID NO: 15221 | VDGVE..... | .......... | .......... | .......M. | NLARINANDI | ESVSLKDAS | AAAVYGAKAS | AGVMLVTTKS | GQE....... | DAAPKISFDL KAGWMQSTVS |
| RS04565 | SEQ ID NO: 15222 | CDGME..... | .......... | .......... | ........V. | SLGQINPNDI | ESTSVLKDAS | AAAIYGAKAS | SGVILVIITKS | GKDS...... | DGKVNVSYNG RFGWRKNTTS |
| RS07885 | SEQ ID NO: 15223 | IDGAE..... | .......... | .......... | .........G. | DLSRVNPNHV | ESISVLKDAS | AAAVYGARAA | FGVILVTTKS | GSEK...... | DGKATVRYSG RVGWEEPTTS |
| RS07765 | SEQ ID NO: 15224 | VDGIP..... | .......... | .......... | .......AE | SYPNINPSDI | ESIEVMLKDAS | AAATYGSRAN | SGVIIITTKS | GKS....... | .GMTKIDVSG RIGFGKLAKD |
| RS10090 | SEQ ID NO: 15225 | IDGVM..... | .......... | .......... | .....TREN | PGTILNSNDV | ESIQVLKDAA | SASIYGAQAA | NGVIIITTKR | .AK....... | KGECRVTFDA TLTLQTYQSG |
| RS05180 | SEQ ID NO: 15226 | VDGTP..... | .......... | .......... | ...VS | DLDNVNPDDV | ESIEVLKDAA | TASIYGARAA | AGVMILVTTK. | GAK....... | EGDLSITYNG EFSLMHASSY |
| RS03505 | SEQ ID NO: 15227 | IDSVE..... | .......... | .......... | ..CALS | QLSELPAADI | ESVSVLKDAA | SAAIYGVRAA | NGVILVTTKR | GQK....... | SEKVSVNYQG SYTLQTPGTL |
| RS02580 | SEQ ID NO: 15228 | VDGMT..... | .......... | .......GIA. | ..ISDVNPGDI | ENISILKDAS | AAAIYGSRAA | NGVIIITTKQ | GME....... | S.RPSVTYSG NISFETVAKR |
| RS05425 | SEQ ID NO: 15229 | VDGMPMR..S | GRS..TGDTG | A.FGSAGATE | PTADLNPEDI | ESLSVTTGAA | AAALYGSEAA | NGAIVITTKK | GEA....... | .GKTKITVGT NTEWNQAWIL |
| RS02610 | SEQ ID NO: 15230 | IDGIPMF..D | VNT..GEEKG | GTMAKQPGSS | SVADINPEDI | ESMSVLSGPS | AAALYGSAAA | SGVILVITTKK | GSE....... | .GRAKLTVSN TTQFHTANMT |
| RS03105 | SEQ ID NO: 15231 | VDGIPML..D | MSRAATQPEG | VVEGAAQTGD | PLSAINPEDI | ENISVLSGES | AAALYGSAAA | NGVMITTKK | GEE....... | .GQTRVITSN NTTFQRVAVM |
| RS09140 | SEQ ID NO: 15232 | IDGIPMP..N | LSDLLDQPED | NFSGMGQQSGD | GASMINPEDI | ESMSVLSGAA | ASALYGSQAS | NGVIIIITTKK | GNT....... | .NGLRVTVSN STQFYRAMAT |
| Consensus | SEQ ID NO: 15233 | IDG.p..... | .......... | .......... | ....lNp.Dl | EsisVlkdaa | aaa..YG.rAa | nGvIiiTTk. | G......... | g..vt.... |
| | SEQ ID NO: 15234 | | | | | | | | | | |

Motif score
☐ >1E−10
☐ >1E−11

Register overlap
☐ 1x
☐ 2x
☐ 3x
☐ 4x
☐ 5x

Tested Epitope: VLKDASAAAIYGSR
Associated with Treg reactivity in healthy mice

FIG. 22

SYSTEMS AND METHODS FOR MHC CLASS II EPITOPE PREDICTION

CROSS-REFERENCE TO RELATED APPLICATIONS

This application is a national stage application of International Application No. PCT/US2018/039843 filed Jun. 27, 2018, which claims the benefit of U.S. Provisional Application No. 62/525,673, filed Jun. 27, 2017. The entire contents of the above-identified applications are hereby fully incorporated herein by reference.

STATEMENT REGARDING FEDERALLY SPONSORED RESEARCH

This invention was made with government support under grant numbers DK043351 and AI109725 awarded by the National Institutes of Health. The government has certain rights in the invention.

REFERENCE TO AN ELECTRONIC SEQUENCE LISTING

The contents of the electronic sequence listing ("BROD-0671US_ST25.txt;" 3.2 MB and created on Mar. 24, 2020) is herein incorporated by reference in its entirety.

REFERENCE TO AN ELECTRONIC SEQUENCE LISTING

The contents of the electronic sequence listing ("BROD-0671US_ST25.txt;" 3.2 MB and created on Mar. 24, 2020) is herein incorporated by reference in its entirety.

TECHNICAL FIELD

This disclosure relates generally to methods and systems for the prediction of MHCII immunodominant epitopes requiring only an annotated genome sequence as an input and methods of using the predicted epitopes.

BACKGROUND

Canonical CD4 T cell responses are restricted to cognate peptide antigen presented by MHCII, which is in turn dictated by sequence-specific interactions between the peptide backbone and MHCII binding groove (Babbitt et al., 1985; Stern et al., 1994). Degeneracy in this interaction allows for presentation of a broad spectrum of peptide antigens and promotes diverse responses to potential antigens. However, CD4 T cell responses tend to be constrained to a limited set of immunodominant epitopes even when the pool of available peptide epitopes is not limiting. Thus, the T cell response must be balanced with respect to the magnitude of the response against any given epitope (to maximize efficacy) and diversity towards multiple epitopes (to combat epitope escape). Despite intensive investigation, the factors controlling immunodominance and antigenicity are incompletely understood.

At the level of antigen presenting cells, several lysosomal pathways contribute to antigen processing and epitope selection (Kim and Sadegh-Nasseri, 2015). In this context, numerous thiol reductases (Arunachalam et al., 2000; Cresswell et al., 1999) and proteases (Hsieh et al., 2002; Hsing and Rudensky, 2005) perform redundant functions in converting native proteins into MHCII ligands. Sequence- and structure-specific preferences of these enzymes for their substrates can bias which peptides are ultimately processed and loaded onto MHCII. Furthermore, kinetic parameters of the peptide-MHCII interaction impact the stability of the complex such that weak-binding peptides are replaced by means of HLA-DM editing (Miyazaki et al., 1996; Schulze and Wucherpfennig, 2012). Taken together, the complexity of antigen processing and limited availability of model immunodominant antigens has posed a barrier to understanding the biochemical features of antigenicity.

Historically, defining immunodominant CD4 T cell epitopes has been empirical. More recently, unbiased approaches for epitope discovery have been introduced. In this context, autologous self-epitopes have been identified by immunoaffinity purification of MHCII-associated peptides followed by Edman degradation sequencing or mass spectrometry (Chicz et al., 1993; Chicz et al., 1992; Hunt et al., 1992; Lippolis et al., 2002; Mommen et al., 2016; Rudensky et al., 1991; Sette et al., 1992; Sofron et al., 2016). Later advancements in mass spectrometry allowed for identification of tumor antigens (Depontieu et al., 2009) and autoantigens (Seamons et al., 2003; Suri et al., 2008). While detection of MHCII-associated peptides derived from exogenous proteins has been achieved (Nelson et al., 1992), identifying epitopes from complex microorganisms remains challenging. Moreover, quantitative assessment of T cell responses to novel epitopes faces technical limitations.

Citation or identification of any document in this application is not an admission that such document is available as prior art to the present invention.

SUMMARY

It is an objective of the present invention to provide novel methods and computer-implemented systems to predict MHCII binding peptides using only a genome sequence of a target cell type or target pathogen (Bacteria originated T cell antigen (BOTA)). It is another objective of the present invention to provide novel methods and systems for identifying immunodominant epitopes for any target cell type or target pathogen and for any MHCII allele. In certain example embodiments, Applicants developed methods and systems that utilize a deep neural network that is trained using peptidomic data obtained by isolating MHC II complexes from antigen presenting cells (e.g., dendritic cells). In certain example embodiments, provided is a broadly applicable technology platform for antigen discovery and specification of immunodominance hierarchies.

In one aspect, the present invention provides for a method of preparing one or more peptides for an immunological composition comprising: identifying MHCII antigenic epitopes for a pathogen, commensal microorganism or diseased cell; and formulating an immunological composition comprising one or more of the identified epitopes, wherein identifying MHCII antigenic epitopes comprises generating, by a processor, a set of candidate antigens from one or more input genome sequences derived from a target pathogen, commensal microorganism or diseased cell, and generating, by the processor, a ranked set of antigenic epitopes from the candidate antigens using a deep neural network. The method may further comprise sequencing a biological sample to generate one or more input genome sequences. The deep neural network may be trained using a set of MHCII-presented peptides bound to antigen presenting cells. The antigen presenting cells may be dendritic cells.

In certain embodiments, generating a set of candidate antigens from one or more input genome sequences comprises: predicting, by the processor, genes from an input genome sequence; and defining, by the processor, a set of candidate antigens from the set of predicted genes based on one or more of protein cellular location, transmembrane structure, and domain distribution. Defining, by the processor, a set of candidate antigens from the set of predicted genes, may comprise: selecting surface and secreted proteins; masking intracellular regions and transmembrane domains of the surface and extracellular proteins; excluding regions that are within domains of less than 30 amino acids; excluding regions between a series of inaccessible domains; and excluding inter-domain regions between a series of adjacent domains wherein the inter-domain regions are less than or equal to 20 amino acids. The method may further comprise masking up to 20 amino acids flanking the intracellular regions and transmembrane domains. In certain embodiments, 8 amino acids flanking the intracellular regions and transmembrane domains are masked. The surface protein may be a cell wall protein. The surface protein may be an outer membrane protein. The antigenic epitopes may be derived from candidate antigens more than 20 amino acids away from a transmembrane domain. The candidate antigens may comprise a tertiary structure required for proteolytic enzyme accessibility. The candidate antigens may comprise a defined MHCII-binding motif in the primary amino acid sequence of the predicted genes. The defined MHCII-binding motif may be the I-A$^b$-binding motif. The antigenic epitopes may comprise a tertiary structure required for accessibility to a MHCII binding groove.

In certain embodiments, generating, by the processor, a ranked set of antigenic epitopes from the candidate antigens using a deep neural network comprises: encoding each amino acid of an input candidate antigen into a p-dimensional binary vector; converting the binary vector to a descriptor matrix S; convoluting the descriptor matrix S to a scoring matrix X; and transforming the scoring matrix X into a d-dimensional vector Z, wherein vector Z is input for a neural network.

In certain embodiments, the antigenic epitopes are specific for an HLA type.

In certain embodiments, the method further comprises: isolating MHCII-peptide complexes from antigen presenting cells; identifying bound peptides from the MHCII-peptide complexes; and training the deep neural network using the set of identified peptides. The antigen presenting cells may be exposed to a target pathogen, commensal microorganism or diseased cell. The antigen presenting cells may be dendritic cells.

In certain embodiments, the candidate antigens are expressed in the pathogen, commensal microorganism or diseased cell.

In certain embodiments, the pathogen is selected from the group consisting of a bacterium, a virus, a protozoon, and an allergen.

In certain embodiments, the diseased cell is a cancer cell. The cancer cell may be obtained from a subject. The method may further comprise identifying non-silent tumor specific somatic mutations from the subject specific cancer cell, wherein the ranked set of antigenic epitopes are generated from said mutations.

In certain embodiments, the diseased cell is associated with an autoimmune disease.

In certain embodiments, the pathogen comprises a bacteria belonging to a family selected from the group consisting of *Bacillus, Bartonella, Bordetella, Borrelia, Brucella, Campylobacter, Chlamydia* and *Chlamydophila, Clostridium, Corynebacterium, Enterococcus, Escherichia, Francisella, Haemophilus, Helicobacter, Legionella, Leptospira, Listeria, Mycobacterium, Mycoplasma, Neisseria, Pseudomonas, Rickettsia, Salmonella, Shigella, Staphylococcus, Streptococcus, Treponema, Ureaplasma, Vibrio,* and *Yersinia*.

In certain embodiments, the commensal microorganism comprises a bacterium belonging to a genus selected from the group consisting of *Bacteroides, Clostridium, Faecalibacterium, Eubacterium, Ruminococcus, Peptococcus, Peptostreptococcus, Bifidobacterium, Lactobacillus* and *Akkermansia*; or a fungus selected from the group consisting of *Candida, Saccharomyces, Aspergillus, Penicillium, Rhodotorula, Trametes, Pleospora, Sclerotinia, Bullera,* and *Galactomyces*.

In certain embodiments, the antigen presenting cell comprises a subject specific MHCII allele. The antigen presenting cell may comprise a human MHCII allele.

In certain embodiments, the one or more input genome sequences is obtained by whole genome or whole exome sequencing.

In certain embodiments, the method further comprises detecting whether one or more of the antigenic epitopes is present in a sample from a subject suffering from an infection, autoimmune disease, allergy, or cancer.

In certain embodiments, the antigenic epitopes are about 9 to 20 amino acids in length.

In certain embodiments, the deep neural network is trained using a set of MHCII-presented peptides comprising one or more of SEQ ID NOs: 1-14979. The deep neural network may be trained using a set of MHCII-presented peptides comprising one or more of SEQ ID NOs: 14980-15027.

In certain embodiments, the immunological composition is a protective vaccine or tolerizing vaccine composition comprising one or more of the antigenic epitopes. The vaccine composition may be directed to a bacterium, a virus or a protozoon. The vaccine composition may be directed to a cancer. The vaccine composition may be directed to an autoimmune disease or allergy, whereby administration of the vaccine induces tolerance to the one or more antigenic epitopes.

In certain embodiments, the vaccine composition is directed to *Listeria*. The vaccine composition may comprise one or more *Listeria* peptides selected from the peptides listed in Table 1. The one or more *Listeria* peptides may be derived from lmo0202, lmo2558, lmo2185, or lmo0135. The one or more *Listeria* peptides may be selected from the group consisting of SEQ ID NO: 14981 (WNEKYAQAYPNVSAKI), SEQ ID NO: 14984 (APGQETQHYYGLPVADSAIDR), SEQ ID NO: 14986 (ADFRYVFDTAKATAASSYPG), and SEQ ID NO: 14997 (VDDTTVKFTLPTVAPAFENT).

In certain embodiments, the vaccine composition comprises autologous dendritic cells or antigen presenting cells pulsed with the one or more epitopes.

In another aspect, the present invention provides for a method of identifying one or more immunodominant epitopes comprising: expressing in a first population of immune cells one or more peptides for an immunological composition prepared according to claim 1, wherein the first population of immune cells comprise a detectable reporter gene; expressing in a second population of CD4+ immune cells a TCRαβ library expressing TCRαβ pairs identified in a subject suffering from an infectious disease, autoimmunity, cancer or allergy; incubating the first population of immune cells with the second population of immune cells; sorting immune cells positive for the detectable reporter gene; and identifying peptides bound to MHCII in immune cells positive for the detectable reporter gene. The TCRαβ pairs may be identified by T cell profiling. The TCRαβ pairs may be determined by targeted single cell RNA-seq (TCRseq). The T cells may be analyzed by RNA-seq to determine single cells having a specific cell state and TCRαβ pairs are identified in the T cells having the specific cell state. The specific cell state may be a protective phenotype or a pathogenic phenotype. The reporter may be an inducible fluorescent marker protein, wherein the marker protein is induced when a TCRαβ pair detects an MHCII epitope. The fluorescent marker may be under control of the IL-2 promoter. The method may further comprise formulating a vaccine composition comprising one or more of the immunodominant epitopes. The vaccine may be a protective vaccine or a tolerizing vaccine. The vaccine may comprise autologous dendritic cells or antigen presenting cells pulsed with one or more of the immunodominant epitopes.

In another aspect, the present invention provides for a method of identifying peptide antigens from a live bacterial pathogen comprising: isolating MHCII-peptide complexes from dendritic cells exposed to a bacterial pathogen; isolating the peptides from the MHCII-peptide complexes; and sequencing the isolated peptides.

In another aspect, the present invention provides for a method of determining immune related health status in a subject comprising: preparing one or more peptides for an immunological composition according to any embodiment herein; exposing the one or more peptides to immune cells obtained from the subject; and measuring cytokine secretion. The cytokines measured may comprise IL-2, IFN-γ, IL-17, and/or IL-10. The method may further comprise measuring immune cell types reactive to the epitopes in the subject. The immune cell types may comprise Treg, Th1, Th17 and/or Th2 cells. The immune cells may be measured using MHCII tetramers.

In another aspect, the present invention provides for a method of determining immune related health status in a subject comprising: preparing one or more peptides for an immunological composition according any embodiment herein; and measuring immune cell types reactive to the epitopes in the subject. The immune cell types may comprise Treg, Th1, Th17 and/or Th2 cells. The immune cells may be measured using MHCII tetramers.

In another aspect, the present invention provides for a method of constructing a deep neural network for identifying MHCII antigenic epitopes comprising: isolating MHCII-peptide complexes from antigen presenting cells expressing a MHCII type; isolating peptides from the MHCII-peptide complexes; sequencing the isolated peptides; and training a deep neural network for predicting antigenic epitopes for the MHCII type using the set of isolated peptides. The deep neural network may be trained by testing randomly initialized parameters for the peptides. The parameters may be tested in a three-fold cross validation scheme. The parameters may comprise cellular localization, inter-domain structure, domain size and/or tertiary structure. The cellular localization may comprise peptides derived from extracellular, intracellular or transmembrane proteins.

In another aspect, the present invention provides for a method for identifying MHCII antigenic epitopes comprising: generating, by a processor, a set of candidate antigens from one or more input genome sequences; and generating, by the processor, a ranked set of antigenic epitopes from the candidate antigens using a deep neural network, wherein the deep neural network is trained using a set of MHCII-presented peptides isolated from antigen presenting cells. The antigen presenting cells may be dendritic cells.

In certain example embodiments, generating, by the processor, a set of candidate antigens from one or more input genome sequences may comprise: predicting, by the processor, genes from an input genome sequence; and defining, by the processor, a set of candidate antigens from the set of predicted genes based on one or more of protein cellular location, transmembrane structure, and domain distribution.

In certain example embodiments, defining, by the processor, a set of candidate antigens from the set of predicted genes, may comprise: selecting surface and secreted proteins; masking intracellular regions and transmembrane domains of the surface proteins; excluding regions that are within domains of less than 30 amino acids; excluding inter-domain regions between transmembrane domains or domains of less than 30 amino acids; and/or excluding inter-domain regions between a series of adjacent domains wherein the inter-domain regions are less than or equal to 20 amino acids. The method may further comprise masking up to 20 amino acids flanking the intracellular regions and transmembrane domains. In certain embodiments, 8 amino acids flanking the intracellular regions and transmembrane domains are masked. In other embodiments, regions located in or between inaccessible domains are excluded. The term "inaccessible domains" as used herein refers to domains that are (1) intracellular, (2) within a transmembrane domain plus 8 amino acids flanking each end, or (3) any domain identified by PFAM that is less than 30 amino acids in length. These criteria were informed by the training dataset (endogenous mouse peptides bound to MHCII). The metric used for domain mapping may be based on other features, such as the distance to the upstream and downstream domains, the density of flanking domains and the size of the domain. MHCII epitopes may be present between small domains, but not present in small domains.

The surface protein may be a cell wall protein. The surface protein may be an outer membrane protein. The antigenic epitopes may be derived from candidate antigens more than 20 amino acids away from a transmembrane domain. The candidate antigens may comprise a tertiary structure required for proteolytic enzyme accessibility (e.g., solvent exposed epitopes rather than buried epitopes). In certain embodiments, protein regions predicted to be accessible by proteases are prioritized. The candidate antigens may comprise a defined MHCII-binding motif in the primary amino acid sequence of the predicted genes. This parameter may be used before, during or after the candidate antigens are provided to the neural network. The defined MHCII-binding motif may be the I-$A^b$-binding motif. The antigenic epitopes may comprise a tertiary structure required for accessibility to a MHCII binding groove.

Generating, by the processor, a ranked set of antigenic epitopes from the candidate antigens using a deep neural network may comprise: encoding each amino acid of an input candidate antigen into a p-dimensional binary vector; converting the binary vector to a descriptor matrix S; convoluting the descriptor matrix S to a scoring matrix X; and transforming the scoring matrix X into a d-dimensional vector Z, wherein vector Z is input for a neural network.

The method of any embodiment described herein may further comprise: isolating MHCII-peptide complexes from antigen presenting cells; isolating the peptides from the MHCII-peptide complexes; sequencing the isolated peptides; and training the deep neural network using the set of isolated peptides. The antigen presenting cells may be exposed to a target cell type or target pathogen. The antigen presenting cells may be dendritic cells.

The input genome sequence may be derived from a target cell type or target pathogen. The candidate antigens may be expressed in the target cell type or target pathogen. The target cell type or target pathogen of any embodiment herein may be selected from the group consisting of a bacterium, a virus, a protozoa, an allergen and a diseased cell.

The diseased cell may be a cancer cell. The cancer cell may be obtained from a subject in need thereof. The method may further comprise identifying non-silent tumor specific somatic mutations from the subject specific cancer cell, wherein the ranked set of antigenic epitopes are generated from said mutations.

The diseased cell may be associated with an autoimmune disease.

The target pathogen may comprise a bacteria belonging to a family selected from the group consisting of *Bacillus, Bartonella, Bordetella, Borrelia, Brucella, Campylobacter, Chlamydia* and *Chlamydophila, Clostridium, Corynebacterium, Enterococcus, Escherichia, Francisella, Haemophilus, Helicobacter, Legionella, Leptospira, Listeria, Mycobacterium, Mycoplasma, Neisseria, Pseudomonas, Rickettsia, Salmonella, Shigella, Staphylococcus, Streptococcus, Treponema, Ureaplasma, Vibrio,* and *Yersinia.*

The antigen presenting cell may comprise a subject specific MHCII allele. The antigen presenting cell may comprise a human MHCII allele. The one or more input genome sequences may be obtained by whole genome or whole exome sequencing. The method may further comprise detecting whether one or more of the antigenic epitopes is present in a sample from a subject suffering from an infection, autoimmune disease, allergy, or cancer. In certain embodiments, such as when identifying immunodominant epitopes for personalized medicine, epitopes that are expressed in a subject in need thereof are selected for an immunogenic composition.

The deep neural network may be trained using a set of MHCII-presented peptides comprising one or more of SEQ ID NOs: 1-14979. The deep neural network may be trained using a set of MHCII-presented peptides comprising one or more of SEQ ID Nos: 14980-15027.

In certain embodiments, the deep neural network trained using a set of MHCII-presented peptides isolated from a dendritic cell can be used to predict antigenic epitopes from any input genome sequence, such as from a pathogen or a different organism. Not being bound by a theory, training the neural network with MHCII-presented peptides provides the neural network with antigenic determinants for generally predicting MHCII binders. The present invention thus provides novel determinants of antigenicity previously not known.

The method may further comprise preparing a vaccine composition comprising one or more antigenic epitopes from the set of antigenic epitopes generated by the processor. The antigenic epitopes may be about 9 to 20 amino acids in length. The vaccine composition may be directed to a bacterium, a virus or a protozoa. The vaccine composition may be directed to a cancer. The vaccine composition may be directed to an autoimmune disease, whereby administration of the vaccine induces tolerance to the antigenic epitope. The vaccine composition may be directed to *Listeria*. The vaccine composition may comprise one or more *Listeria* peptides selected from the peptides listed in Table 1. The one or more *Listeria* peptides may be derived from lmo0202, lmo2558, lmo2185, or lmo0135. The one or more *Listeria* peptides may be selected from the group consisting of SEQ ID NO: 14981 (WNEKYAQAYPNVSAKI), SEQ ID NO: 14984 (APGQETQHYYGLPVADSAIDR), SEQ ID NO: 14986 (ADFRYVFDTAKATAASSYPG), and SEQ ID NO: 14997 (VDDTTVKFTLPTVAPAFENT). Not being bound by a theory, the vaccine may be directed to (1) any microbial pathogen, (2) any commensal microorganism, (3) any food allergen, (4) any tumor/malignancy, (5) any host tissue that is targeted by adaptive immune system in autoimmune disease. The method may be used to prepare tolerizing vaccines or protective vaccines. The vaccine may comprise autologous dendritic cells or antigen presenting cells pulsed with the one or more peptides.

In another aspect, the present invention provides for a method of identifying immunodominant epitopes comprising: expressing in a first population of immune cells a peptide MHCII library comprising antigenic epitopes identified according to the method of any embodiment herein, wherein the first population of immune cells comprise a detectable reporter gene; expressing in a second population of CD4+ immune cells a TCRab library expressing TCRab pairs identified in a subject suffering from an infectious disease, autoimmunity, cancer or allergy; incubating the first population of immune cells with the second population of immune cells; sorting immune cells positive for the detectable reporter gene; and identifying peptides bound to MHCII in immune cells positive for the detectable reporter gene. The TCRab pairs may be identified by single cell profiling. The TCRab pairs may be determined by targeted single cell RNA-seq (TCRseq). The T cells may be analyzed by RNA-seq to determine single cells that are activated and TCRab pairs are identified in the activated T cells. The reporter may be an inducible fluorescent marker protein, wherein the marker protein is induced when a TCRab pair detects a MHCII epitope. The fluorescent marker may be under control of the IL-2 promoter. The method may further comprise administering to the subject a vaccine comprising one or more of the immunodominant epitopes. The vaccine may be a protective vaccine or a tolerizing vaccine. The vaccine may comprise autologous dendritic cells or antigen presenting cells pulsed with one or more of the immunodominant epitopes.

In another aspect, the present invention provides for a method of identifying peptide antigens from a live bacterial pathogen comprising: isolating MHCII-peptide complexes from dendritic cells exposed to a bacterial pathogen; isolating the peptides from the MHCII-peptide complexes; and sequencing the isolated peptides.

In another aspect, the present invention provides for a peptide set for training a MHCII neural network comprising one or more of SEQ ID NOs: 1-14979.

In another aspect, the present invention provides for a peptide set for training a MHCII neural network comprising one or more of SEQ ID NOs: 14980-15027.

In another aspect, the present invention provides for a *Listeria* vaccine comprising one or more peptides selected from the peptides listed in Table 1. The one or more peptides may be derived from lmo0202, lmo2558, lmo2185, or lmo0135. The one or more *Listeria* peptides may be selected from the group consisting of SEQ ID NO: 14981 (WNEKYAQAYPNVSAKI), SEQ ID NO: 14984 (APGQETQHYYGLPVADSAIDR), SEQ ID NO: 14986 (ADFRYVFDTAKATAASSYPG), and SEQ ID NO: 14997 (VDDTTVKFTLPTVAPAFENT). The vaccine may comprise autologous dendritic cells or antigen presenting cells pulsed with the one or more peptides.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

FIG. 7—MHCII peptidomics in primary murine dendritic cells results in more than 3,700 distinct peptide identifications and defines the I-A$^b$-binding motif. FIG. 7A is an example experimental workflow for immunopurification and sequencing of MHCII-associated peptides from murine dendritic cells. MHCII-peptide complexes were immunopurified from WT and Atg16l1$^{-/-}$ cells. Associated peptides were then acid-eluted, labeled with iTRAQ4 reagents, desalted with SCX and C18, and analyzed using high resolution LC-MS/MS. FIG. 7B is an example database search strategy for MHCII-peptide sequencing. All MS/MS spectra were searched against a database containing mouse proteins using Spectrum Mill software with a "no enzyme" specificity. Mouse peptides were validated using a 1% FDR cutoff, and the total numbers of peptides quantified across all samples were reported. FIG. 7C is the I-Ab-binding motif was derived from endogenous mouse peptides bound to MHCII. Heatmap shading represents the frequencies of each amino acid at each respective position.

FIG. 8—Antigen processing pathways and epitope features revealed by MHCII peptidomics.

FIG. 9—Validation of BOTA epitope predictions with MHCII peptidomics.

FIGS. 10 C, D and E show that immunodominance in vivo correlates with fold change (FC) of Listeria peptides quantified by MHCII peptidomics, and to a lesser extent, with mRNA expression (normalized microarray probe intensity) of the corresponding peptide-encoding genes.

FIG. 11—Single cell TCR sequencing defines the clonal architecture of the anti-Listeria response. Mice were inoculated with Listeria by i.p. injection. Six days later, CD4+ CD25+CD69+ T cells were FACS-sorted from spleens for single cell RNA-seq and TCRseq. FIG. 11A shows a tSNE plot derived from T cell transcriptomes identifies 3 distinct cell states that cluster according to unique signatures. Each dot represents a single cell that is color coded according to gene signature. FIG. 11B shows that TCRseq defines the CD4 T cell response to *Listeria*. Each dot represents a single cell that is shaded according to expression of Ifng. FIG. 11C shows that each dot represents a single cell that is shaded according to expression of Tbx21.

FIG. 12—Single cell RNA-seq integrates T cell phenotype with TCR repertoire in the *Listeria* response. Mice were inoculated with *Listeria* by i.p. injection on days 0 and 11. On day 18, FSC$^{HI}$CD4$^+$CD8$^-$B220$^-$MHCII$^-$ T cells were FACS-sorted from spleens for single cell RNA-seq and TCRseq. Sorted T cells were derived from 2 mice, sequenced separately, and combined for analysis.

FIG. 13—Specifying immunodominance by screening TCRs for reactivity with *Listeria* epitopes predicted by BOTA.

FIG. 14—Specifying antigen-reactivity by screening TCRs for reactivity with *Listeria* epitopes predicted by BOTA. FIG. 14A shows the screen overview. HEK 293T cells were transfected to express peptide epitopes fused in-frame with the I-A$^b$β chain bearing CD3ζ cytoplasmic domains. BW5147_CD4-28 cells were transduced to express chimeric single chain TCRs bearing the transmembrane and cytoplasmic domains of CD3ζ. In this coculture system, cognate antigen recognition results in T cell activation characterized by production of IL-2. FIG. 14B shows that the most abundant TCR identified in mice infected with *Listeria* (lmo_R6) was screened for reactivity against *Listeria* epitopes as described above. IL-2 was detected in culture supernatant by cytometric bead array. As controls, OT2 TCR (reactive with Ova) and LLO_118 TCR (reactive with LLO) were included. Shown are SEQ ID NOs: 15200-15204, from left to right. FIG. 14C shows that HEK 293T cells were transfected with constructs encoding single chain TCRs. Cells were analyzed by FACS for expression of TCRb and binding to LLO I-A$^b$ tetramers (NEKYAQAYPNVS I-A$^b$) (SEQ ID NOs: 15205).

FIG. 15—Computational prediction and validation of a dominant commensal antigen.

FIG. 19—TCR Finger-Printing.

TCRζ construct. Upon engagement of the OT2 TCR with cognate Ova(323-339) presented by MHCIIζζ, responder cells express the activation marker 41bb. Activated MHCII+ 41bb+ cells were FACS-sorted, and sequencing libraries were constructed by PCR amplification of the Ova-encoding region of lentiviral integrants.

FIG. 22—Illustrates features of immunogenicity for SusC epitopes associated with Treg reactivity in healthy mice. Shown are SEQ ID NOs: 15219-15234, starting with the top sequence.

DETAILED DESCRIPTION OF THE EXAMPLE EMBODIMENTS

General Definitions

Figure 1:
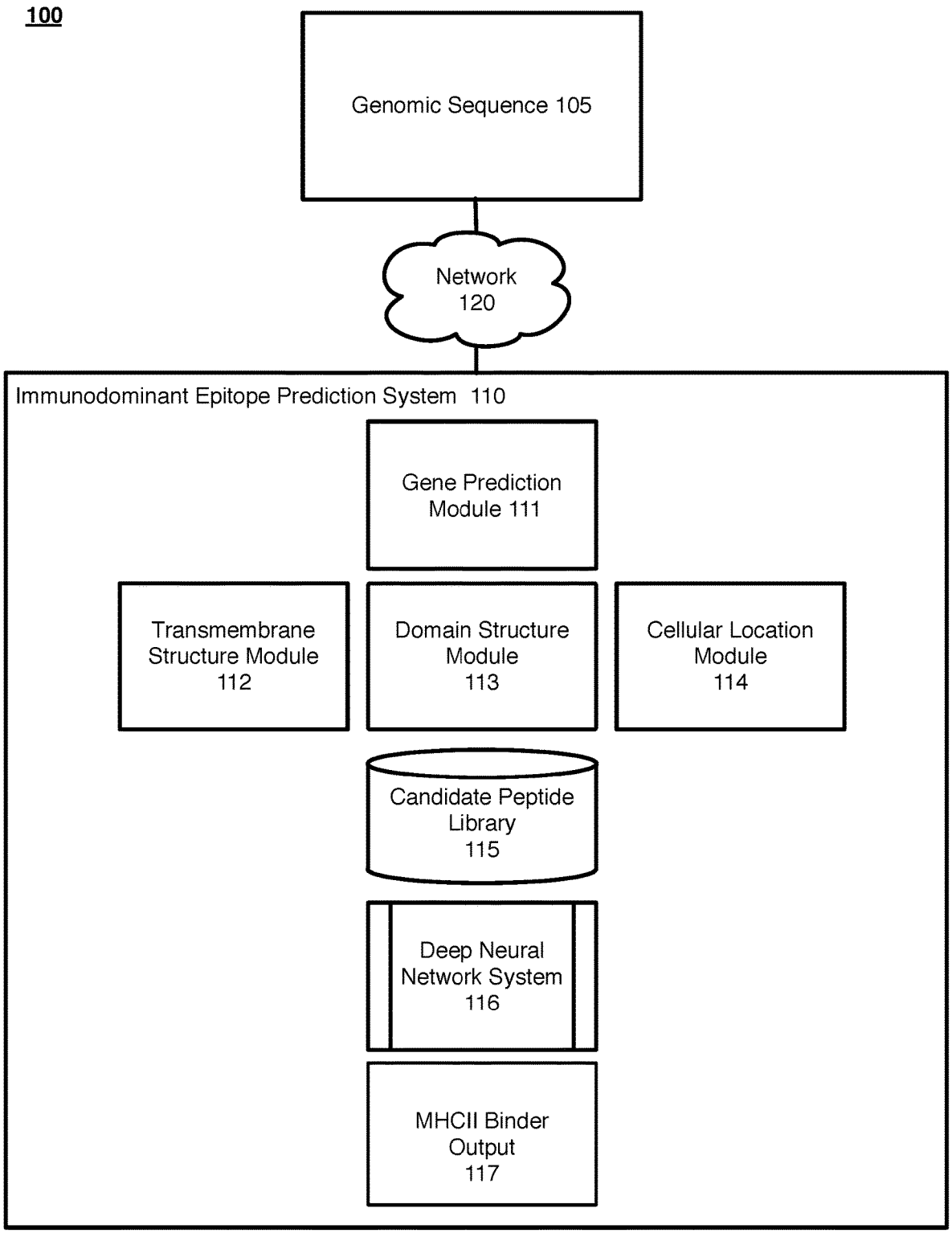
FIG. 1—block diagram depicting a system for identifying MHCII antigenic epitopes.

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E. A. Greenfield ed.); Animal Cell Culture (1987) (R. I. Freshney, ed.); Benjamin Lewin, Genes IX, published by Jones and Bartlett, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

All publications, published patent documents, and patent applications cited in this application are indicative of the level of skill in the art(s) to which the application pertains. All publications, published patent documents, and patent applications cited herein are hereby incorporated by reference to the same extent as though each individual publication, published patent document, or patent application was specifically and individually indicated as being incorporated by reference.

Overview

Defining the immunodominance hierarchy of T cell epitopes remains a significant challenge in the context of infectious disease, commensal immunity, autoimmunity, and immune oncology. Even for some of the most widespread bacterial pathogens, little is known about which antigens drive protective CD4 T cell responses. In one aspect, embodiments herein provide computer-implemented techniques for predicting MHCII binding epitopes using sequencing data. In certain example embodiments, the sequencing data is whole genome data, whole exome sequencing data (WES), RNA-seq data, targeted exome sequencing data, or any form of sequencing data that allows gene prediction at either the exome, genome, or RNA levels. In certain example embodiments, it is not necessary to have a complete genome to identify all useful epitopes. For ease of reference, the sequencing data as described above may be used interchangeably. In certain embodiments, only 90% of a genome or 90% of an exome is required to predict MHCII binding epitopes. In certain embodiments, predictions can be made from metagenomics (i.e., genomic sequencing from a complex mixture of microbes in stool) in which coverage of any given microbe's genome may be as low as 1%. In certain embodiments, de novo predictions can be made from sequencing reads directly from metagenomics or transcriptomics without mapping to a genome (e.g., essentially 0% known genome).

As a consequence of deep profiling of the MHC II immunopeptidome, a rich dataset was generated for identifying key features of antigenicity and derivation of the computer-implemented methods disclosed herein. Accordingly, the computer-implemented methods disclosed herein incorporate several important attributes of immunodominant epitopes revealed by proteomics.

The improvement on predication accuracy of the computer-implemented methods disclosed herein also signifies the successful application of deep neural network solving to a complex biomedical problem. Previous efforts using traditional networks or hidden Markov Models were limited by their ability to extract highly abstract features, thus leading to insufficient insights into epitope prediction. The computer-implemented methods disclosed herein can be used to predict CD4 T cell epitopes for virtually any MHC II allele and any antigen source, including commensal microbes, pathogens, autoantigens, and tumor antigens. The embodiments disclosed herein demonstrate the utility of MHCII peptidomics for training a deep neural network that specifically identifies epitopes with key features associated with immunodominance. Furthermore, the embodiments disclosed herein serve as a powerful tool for unbiased discovery of complex pathogen and for interrogation of host pathways underlying human disease.

In certain embodiments, MHCII binding epitopes may be predicted using known MHCII binding motifs. The known binding motifs may be incorporated into the described systems and methods. Candidate antigens with a known binding motif may be used as input to the deep neural network system 116. In one embodiment, human HLA class II binding motifs may be used (see e.g., Andreatta and Nielsen, "Characterizing the binding motifs of 11 common human HLA-DP and HLA-DQ molecules using NNAlign" Immunology. 2012 July; 136(3): 306-311).

Turning now to FIGS. 1-6, in which like numerals represent like (but not necessarily identical) elements throughout the figures, example embodiments are described in detail.

Example Epitope Prediction System Architectures

FIG. 1 is a block diagram depicting an epitope prediction system 100 for predicting MHCII binding antigens using nucleic acid sequencing data (e.g., BOTA). As depicted in FIG. 1, the operating environment 100 includes network devices 105 and 110 that are configured to communicate with one another via one or more networks 120. In some embodiments, the genomic sequencing device 105 may provide sequencing data directly from real time sequencing reads. In other example embodiments, the genomic sequencing device comprises a storage device 106. The storage device 106 may comprise a database or be linked to a database comprising sequencing files 107. In some embodiments, a user associated with a device must install an application and/or make a feature selection to obtain the benefits of the techniques described herein. The epitope prediction system 110 receives genomic data and outputs a set of identified ranked epitopes from the sequencing data. BOTA scoring reflects the likelihood of a given epitope being immunodominant.

In certain embodiments, sequencing comprises high-throughput (formerly "next-generation") technologies to generate sequencing reads. In DNA sequencing, a read is an inferred sequence of base pairs (or base pair probabilities) corresponding to all or part of a single DNA fragment. A typical sequencing experiment involves fragmentation of the genome into millions of molecules or generating complementary DNA (cDNA) fragments, which are size-selected and ligated to adapters. The set of fragments is referred to as a sequencing library, which is sequenced to produce a set of reads. Methods for constructing sequencing libraries are known in the art (see, e.g., Head et al., Library construction for next-generation sequencing: Overviews and challenges. Biotechniques. 2014; 56(2): 61-77). In certain embodiments, the library members (e.g., genomic DNA, cDNA) may include sequencing adaptors that are compatible with use in, e.g., Illumina's reversible terminator method, Roche's pyrosequencing method (454), Life Technologies' sequencing by ligation (the SOLID platform) or Life Technologies' Ion Torrent platform. Examples of such methods are described in the following references: Margulies et al (Nature 2005 437:376-80); Ronaghi et al (Analytical Biochemistry 1996 242:84-9); Shendure et al (Science 2005 309:1728-32); Imelfort et al (Brief Bioinform. 2009 10:609-18); Fox et al (Methods Mol. Biol. 2009; 553:79-108); Appleby et al (Methods Mol. Biol. 2009; 513:19-39); and Morozova et al (Genomics. 2008 92:255-64), which are incorporated by reference for the general descriptions of the methods and the particular steps of the methods, including all starting products, reagents, and final products for each of the steps.

In certain embodiments, the present invention includes whole genome sequencing. Whole genome sequencing (also known as WGS, full genome sequencing, complete genome sequencing, or entire genome sequencing) is the process of determining the complete DNA sequence of an organism's genome at a single time. This entails sequencing all of an organism's chromosomal DNA as well as DNA contained in the mitochondria and, for plants, in the chloroplast.

In certain embodiments, the present invention includes whole exome sequencing. Exome sequencing, also known as whole exome sequencing (WES), is a genomic technique for sequencing all of the protein-coding genes in a genome (known as the exome) (see, e.g., Ng et al., 2009, Nature volume 461, pages 272-276). It consists of two steps: the first step is to select only the subset of DNA that encodes proteins. These regions are known as exons—humans have about 180,000 exons, constituting about 1% of the human genome, or approximately 30 million base pairs. The second step is to sequence the exonic DNA using any high-throughput DNA sequencing technology.

In certain embodiments, targeted sequencing is used in the present invention (see, e.g., Mantere et al., PLOS Genet 12 e1005816 2016; and Carneiro et al. BMC Genomics, 2012 13:375). Targeted gene sequencing panels are useful tools for analyzing specific mutations in a given sample. Focused panels contain a select set of genes or gene regions that have known or suspected associations with the disease or phenotype under study.

Each network device 105 and 110 includes a device having a communication module capable of transmitting and receiving data over the network 120. For example, each network device 105 and 110 can include a server, desktop computer, laptop computer, tablet computer, a television with one or more processors embedded therein and/or coupled thereto, smart phone, handheld computer, personal digital assistant ("PDA"), or any other wired or wireless, processor-driven device.

The genomic sequencing device 105 may generate sequence data files 107 comprising information on the coding regions of genes within a given biological sample. In one example embodiment, the sequencing device may directly communicate the data file to the epitope prediction system 110 across the network 120 and the epitope prediction and ranking is conducted in line with the sequencing analysis. In another example embodiment, the sequencing data file may be stored on a data storage medium and later uploaded to the epitope prediction system 110 for further analysis.

The epitope prediction system 110 may comprise a peptide prediction module 111, a epitope ranking module 113, a candidate peptide library index 112, and a candidate epitope module 114. The peptide prediction module 111 predicts protein coding genes from the input genomic sequencing data file 107 and generates a list of candidate peptides based on various selection criteria described below. In certain example embodiments, the peptide prediction module 111 stores the candidate peptides in the candidate peptide library index 112.

It will be appreciated that the network connections shown are examples and other means of establishing a communications link between the computers and devices can be used. Moreover, those having ordinary skill in the art having the benefit of the present disclosure will appreciate that the Epitope Prediction System 110, can have any of several other suitable computer system configurations.

Example Processes

Figure 2:
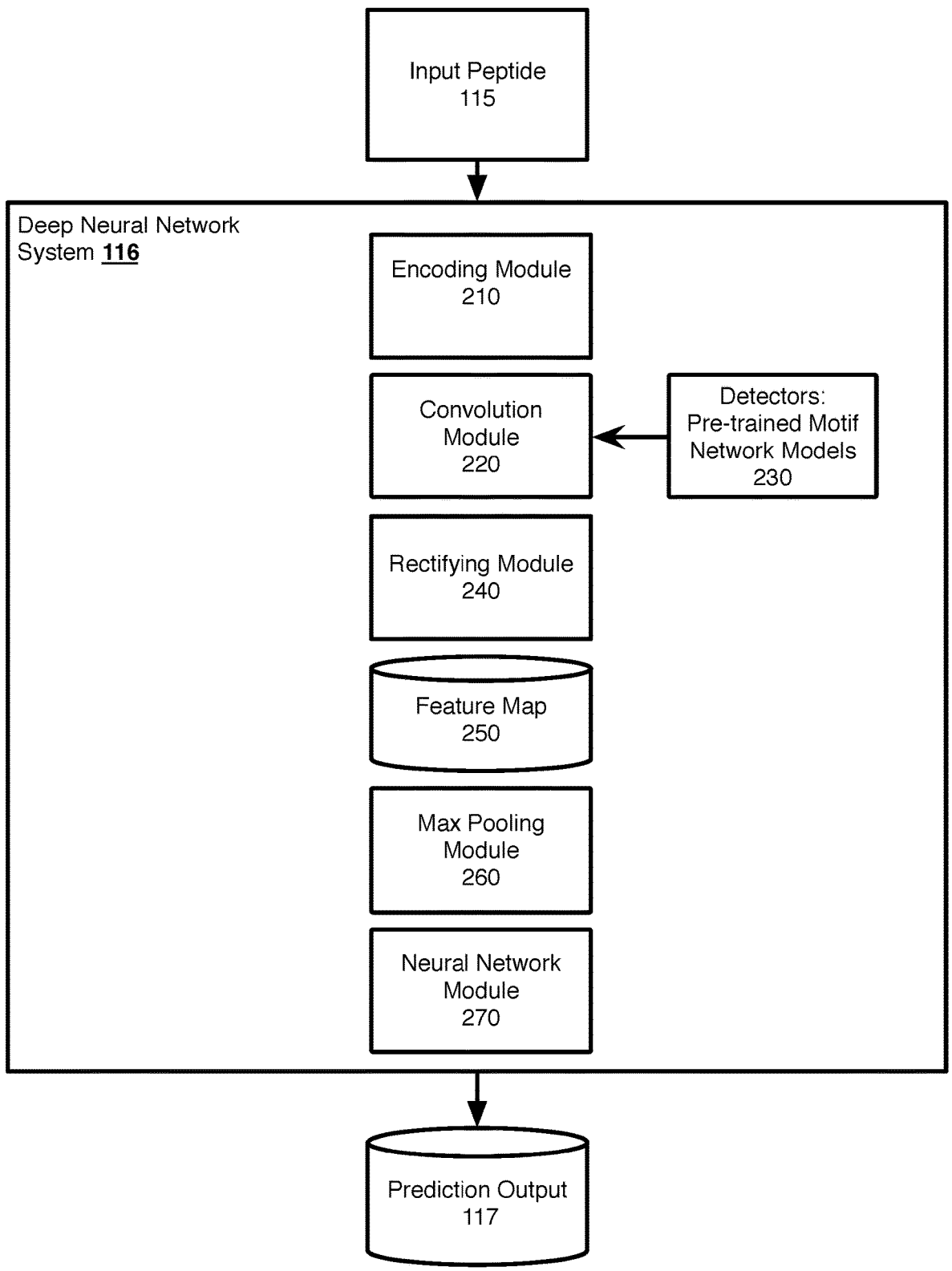
FIG. 2—block diagram depicting a system for a deep neural network for predicting binding of peptides to MHCII molecules.
Figure 3:
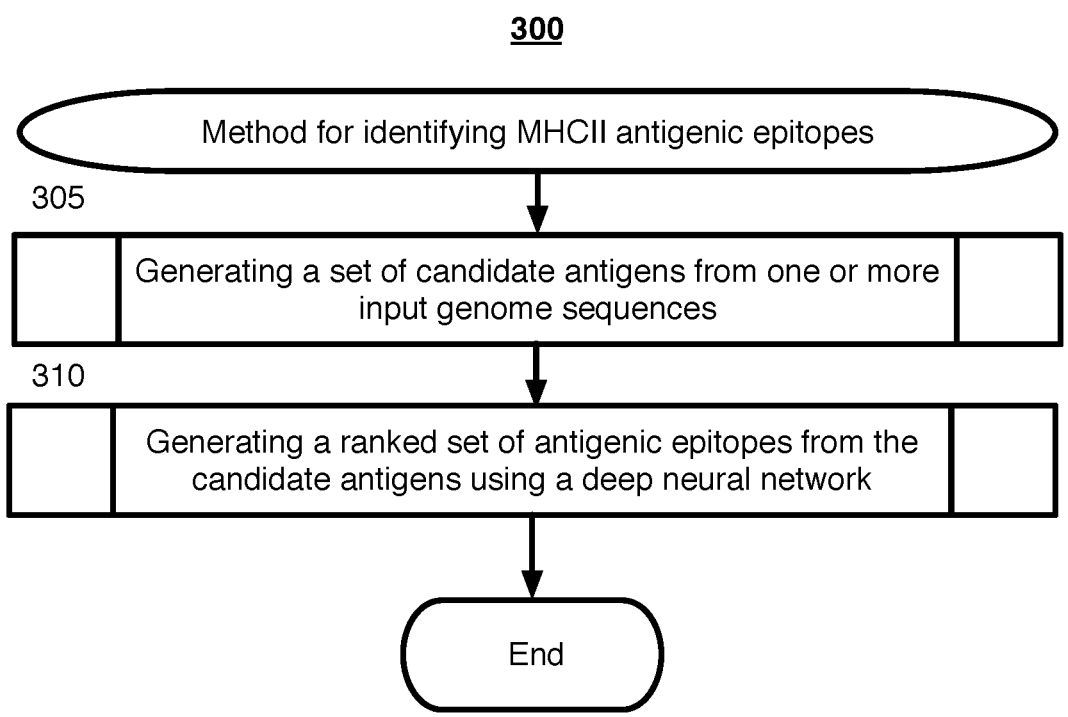
FIG. 3—block diagram depicting a method for identifying MHCII antigenic epitopes.
Figure 4:
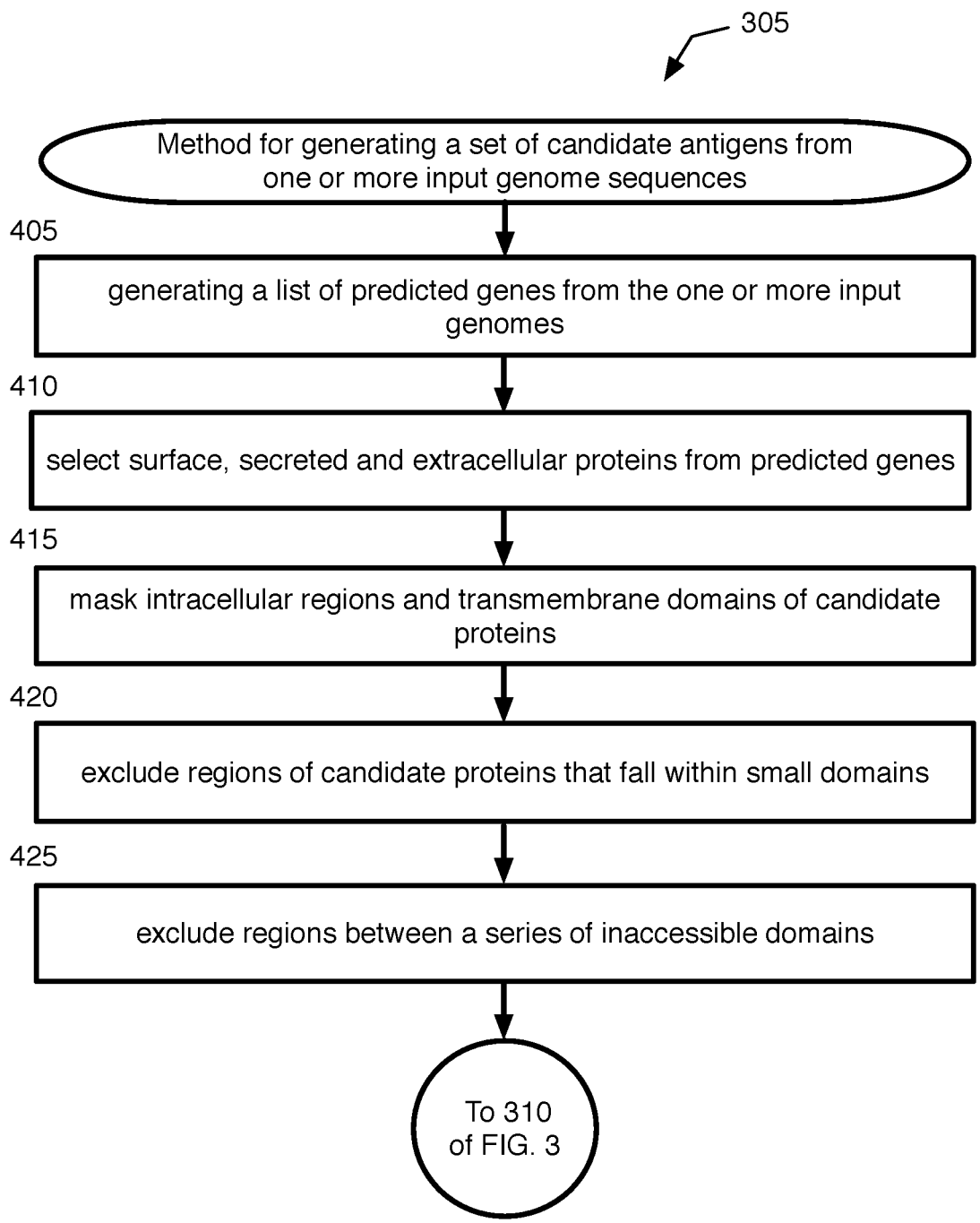
FIG. 4—block diagram depicting a method for generating a set of candidate antigens from one or more input genome sequences.

The example methods illustrated in FIGS. 2-4 are described hereinafter with respect to the components of the example operating environment 100. The example methods of FIGS. 2-4 may also be performed with other systems and in other environments.

FIG. 2 is a block flow diagram depicting a method 300 for identifying MHCII antigenic epitopes an input genome sequence, in accordance with certain example embodiments.

The input genome sequence according to any embodiment described herein may be derived from any target cell type or target pathogen. In certain embodiments, the input genome sequence may be derived from the target cell type or target pathogen exposed to a dendritic cell in any embodiment described herein. The target cell type or target pathogen may be selected from the group consisting of a bacterium, virus, protozoa, and diseased cell. The diseased cell may be a cancer cell. The cancer cell may be obtained from a subject in need thereof. The method may further comprise identifying non-silent tumor specific somatic mutations from the input genome sequence, wherein the antigenic epitopes are derived from said mutations. Not being bound by a theory, a cancer obtains non-inherited mutations that can produce non-self tumor specific mutations. The tumor specific mutations can produce tumor specific antigens that are ideal for targeting by the immune system. Identifying non-silent tumor specific somatic mutations from the input genome sequence may be determined by sequencing tumor tissue from a subject and comparing the sequence to that of non-tumor tissue from the same subject or from germline tissue from the same subject. The diseased cell may be associated with an autoimmune disease.

In certain example embodiments, the target pathogen is a bacterium. Examples of pathogenic bacteria that can be detected in accordance with the disclosed methods include without limitation any one or more of (or any combination of) *Acinetobacter baumannii*, *Actinobacillus* sp., *Actinomy-cetes*, *Actinomyces* sp. (such as *Actinomyces israelii* and *Actinomyces naeslundii*), *Aeromonas* sp. (such as *Aeromonas hydrophila*, *Aeromonas veronii* biovar *sobria* (*Aeromonas sobria*), and *Aeromonas caviae*), *Anaplasma phagocytophilum*, *Anaplasma marginale*, *Alcaligenes xylosoxidans*, *Acinetobacter baumannii*, *Actinobacillus actinomycetemcomitans*, *Bacillus* sp. (such as *Bacillus anthracis*, *Bacillus cereus*, *Bacillus subtilis*, *Bacillus thuringiensis*, and *Bacillus stearothermophilus*), *Bacteroides* sp. (such as *Bacteroides fragilis*), *Bartonella* sp. (such as *Bartonella bacilliformis*) and *Bartonella henselae*, *Bifidobacterium* sp., *Bordetella* sp. (such as *Bordetella pertussis*, *Bordetella parapertussis*, and *Bordetella bronchiseptica*), *Borrelia* sp. (such as *Borrelia recurrentis*, and *Borrelia burgdorferi*), *Brucella* sp. (such as *Brucella abortus*, *Brucella canis*, *Brucella melitensis* and *Brucella suis*), *Burkholderia* sp. (such as *Burkholderia pseudomallei* and *Burkholderia cepacia*), *Campylobacter* sp. (such as *Campylobacter jejuni*, *Campylobacter coli*, *Campylobacter lari* and *Campylobacter fetus*), *Capnocytophaga* sp., *Cardiobacterium hominis*, *Chlamydia trachomatis*, *Chlamydophila pneumoniae*, *Chlamydophila psittaci*, *Citrobacter* sp. *Coxiella burnetii*, *Corynebacterium* sp. (such as, *Corynebacterium diphtheriae*, *Corynebacterium jeikeium* and *Corynebacterium*), *Clostridium* sp. (such as *Clostridium perfringens*, *Clostridium difficile*, *Clostridium botulinum* and *Clostridium tetani*), *Eikenella corrodens*, *Enterobacter* sp. (such as *Enterobacter aerogenes*, *Enterobacter agglomerans*, *Enterobacter cloacae* and *Escherichia coli*, including opportunistic *Escherichia coli*, such as enterotoxigenic *E. coli*, enteroinvasive *E. coli*, enteropathogenic *E. coli*, enterohemorrhagic *E. coli*, enteroaggregative *E. coli* and uropathogenic *E. coli*) *Enterococcus* sp. (such as *Enterococcus faecalis* and *Enterococcus faecium*) *Ehrlichia* sp. (such as *Ehrlichia chaffeensis* and *Ehrlichia canis*), *Erysipelothrix rhusiopathiae*, *Eubacterium* sp., *Francisella tularensis*, *Fusobacterium nucleatum*, *Gardnerella vaginalis*, *Gemella morbillorum*, *Haemophilus* sp. (such as *Haemophilus influenzae*, *Haemophilus ducreyi*, *Haemophilus aegyptius*, *Haemophilus parainfluenzae*, *Haemophilus haemolyticus* and *Haemophilus parahaemolyticus*), *Helicobacter* sp. (such as *Helicobacter pylori*, *Helicobacter cinaedi* and *Helicobacter fennelliae*), *Kingella kingae*, *Klebsiella* sp. (such as *Klebsiella pneumoniae*, *Klebsiella granulomatis* and *Klebsiella oxytoca*), *Lactobacillus* sp., *Listeria monocytogenes*, *Leptospira interrogans*, *Legionella pneumophila*, *Leptospira interrogans*, *Peptostreptococcus* sp., *Mannheimia haemolytica*, *Moraxella catarrhalis*, *Morganella* sp., *Mobiluncus* sp., *Micrococcus* sp., *Mycobacterium* sp. (such as *Mycobacterium leprae*, *Mycobacterium tuberculosis*, *Mycobacterium paratuberculosis*, *Mycobacterium intracellulare*, *Mycobacterium avium*, *Mycobacterium bovis*, and *Mycobacterium marinum*), *Mycoplasma* sp. (such as *Mycoplasma pneumoniae*, *Mycoplasma hominis*, and *Mycoplasma genitalium*), *Nocardia* sp. (such as *Nocardia asteroides*, *Nocardia cyriacigeorgica* and *Nocardia brasiliensis*), *Neisseria* sp. (such as *Neisseria gonorrhoeae* and *Neisseria meningitidis*), *Pasteurella multocida*, *Plesiomonas shigelloides*. *Prevotella* sp., *Porphyromonas* sp., *Prevotella melaninogenica*, *Proteus* sp. (such as *Proteus vulgaris* and *Proteus mirabilis*), *Providencia* sp. (such as *Providencia alcalifaciens*, *Providencia rettgeri* and *Providencia stuartii*), *Pseudomonas aeruginosa*, *Propionibacterium acnes*, *Rhodococcus equi*, *Rickettsia* sp. (such as *Rickettsia rickettsii*, *Rickettsia akari* and *Rickettsia prowazekii*, *Orientia tsutsugamushi* (formerly: *Rickettsia tsutsugamushi*) and *Rickettsia typhi*), *Rhodococcus* sp., *Serratia marcescens*, *Stenotrophomonas maltophilia*, *Salmonella* sp.

(such as *Salmonella enterica, Salmonella typhi, Salmonella paratyphi, Salmonella enteritidis, Salmonella choleraesuis* and *Salmonella typhimurium*), *Serratia* sp. (such as *Serratia marcescens* and *Serratia liquefaciens*), *Shigella* sp. (such as *Shigella dysenteriae, Shigella flexneri, Shigella boydii* and *Shigella sonnei*), *Staphylococcus* sp. (such as *Staphylococcus aureus, Staphylococcus epidermidis, Staphylococcus haemolyticus Staphylococcus saprophyticus*), *Streptococcus* sp. (such as *Streptococcus pneumoniae* (for example chloramphenicol-resistant serotype 4 *Streptococcus pneumoniae*, spectinomycin-resistant serotype 6B *Streptococcus pneumoniae*, streptomycin-resistant serotype 9V *Streptococcus pneumoniae*, erythromycin-resistant serotype 14 *Streptococcus pneumoniae*, optochin-resistant serotype 14 *Streptococcus pneumoniae*, rifampicin-resistant serotype 18C *Streptococcus pneumoniae*, tetracycline-resistant serotype 19F *Streptococcus pneumoniae*, penicillin-resistant serotype 19F *Streptococcus pneumoniae*, and trimethoprim-resistant serotype 23F *Streptococcus pneumoniae*, chloramphenicol-resistant serotype 4 *Streptococcus pneumoniae*, spectinomycin-resistant serotype 6B *Streptococcus pneumoniae*, streptomycin-resistant serotype 9V *Streptococcus pneumoniae*, optochin-resistant serotype 14 *Streptococcus pneumoniae*, rifampicin-resistant serotype 18C *Streptococcus pneumoniae*, penicillin-resistant serotype 19F *Streptococcus pneumoniae*, or trimethoprim-resistant serotype 23F *Streptococcus pneumoniae*), *Streptococcus agalactiae, Streptococcus mutans, Streptococcus pyogenes*, Group A streptococci, *Streptococcus pyogenes*, Group B streptococci, *Streptococcus agalactiae*, Group C streptococci, *Streptococcus anginosus, Streptococcus equisimilis*, Group D streptococci, *Streptococcus bovis*, Group F streptococci, and *Streptococcus anginosus* Group G streptococci), Spirillum minus, *Streptobacillus moniliformis, Treponema* sp. (such as *Treponema carateum, Treponema pertenue, Treponema pallidum* and *Treponema endemicum, Tropheryma whippelii, Ureaplasma urealyticum, Veillonella* sp., *Vibrio* sp. (such as *Vibrio cholerae, Vibrio vulnificus, Vibrio parahaemolyticus, Vibrio vulnificus, Vibrio alginolyticus, Vibrio mimicus, Vibrio hollisae, Vibrio fluvialis, Vibrio metschnikovii, Vibrio damsela* and *Vibrio furnissii*), *Yersinia* sp. (such as *Yersinia enterocolitica, Yersinia pestis*, and *Yersinia pseudotuberculosis*) and *Xanthomonas maltophilia* among others.

In certain example embodiments, the target pathogen is a fungus. Examples of fungi that can be detected in accordance with the disclosed methods include without limitation any one or more of (or any combination of), *Aspergillus, Blastomyces, Candidiasis, Coccidioidomycosis, Cryptococcus neoformans, Cryptococcus gattii, Histoplasma, Mucormycosis, Pneumocystis, Sporothrix*, fungal eye infections ringwork, *Exserohilum*, and *Cladosporium*.

In certain example embodiments, the fungus is a yeast. Examples of yeast that can be detected in accordance with disclosed methods include without limitation one or more of (or any combination of), *Aspergillus* species, a *Geotrichum* species, a *Saccharomyces* species, a *Hansenula* species, a *Candida* species, a *Kluyveromyces* species, a *Debaryomyces* species, a *Pichia* species, or combination thereof. In certain example embodiments, the fungus is a mold. Example molds include, but are not limited to, a *Penicillium* species, a *Cladosporium* species, a *Byssochlamys* species, or a combination thereof.

In certain example embodiments, the target pathogen may be a virus. The virus may be a DNA virus, a RNA virus, or a retrovirus. Example of RNA viruses that may be detected include one or more of (or any combination of) Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. In certain example embodiments, the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In certain example embodiments, the virus may be a retrovirus. Example retroviruses that may be detected using the embodiments disclosed herein include one or more of or any combination of viruses of the Genus Alpharetrovirus, Betaretrovirus, Gammaretrovirus, Deltaretrovirus, Epsilonretrovirus, Lentivirus, Spumavirus, or the Family Metaviridae, Pseudoviridae, and Retroviridae (including HIV), Hepadnaviridae (including Hepatitis B virus), and Caulimoviridae (including Cauliflower mosaic virus).

In certain example embodiments, the virus is a DNA virus. Example DNA viruses that may be detected using the embodiments disclosed herein include one or more of (or any combination of) viruses from the Family Myoviridae, Podoviridae, Siphoviridae, Alloherpesviridae, Herpesviridae (including human herpes virus, and Varicella Zoster virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Marseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus, among others.

In certain example embodiments, the target pathogen may be a protozoon. Examples of protozoa include without limitation any one or more of (or any combination of), Euglenozoa, Heterolobosea, Diplomonadida, Amoebozoa, *Blastocystis*, and Apicomplexa. Example Euglenozoa include, but are not limited to, *Trypanosoma cruzi* (Chagas disease), *T. brucei* gambiense, *T. brucei* rhodesiense, *Leishmania braziliensis, L. infantum, L. mexicana, L. major, L. tropica*, and *L. donovani*. Example Heterolobosea include, but are not limited to, *Naegleria fowleri*. Example Diplomonadid include, but are not limited to, Giardia intestinalis (*G. lamblia, G. duodenalis*). Example Amoebozoa include, but are not limited to, *Acanthamoeba castellanii, Balamuthia mandrillaris, Entamoeba histolytica*. Example *Blastocystis* include, but are not limited to, *Blastocystis hominis*. Example Apicomplexa include, but are not limited to, *Babesia microti, Cryptosporidium parvum, Cyclospora cayetanensis, Plasmodium falciparum, P. vivax, P. ovale, P. malariae*, and *Toxoplasma gondii*.

In certain example embodiments, the target epitopes are present on a commensal microorganism. The Human Microbiome Project sequenced the genome of the human microbiota, focusing particularly on the microbiota that normally inhabit the skin, mouth, nose, digestive tract, and vagina (see, e.g., hmpdacc.org/hmp/). MHCII epitopes may be predicted any of the microorganisms described.

The four dominant bacterial phyla in the human gut are Firmicutes, Bacteroidetes, Actinobacteria, and Proteobacteria. Most bacteria belong to the genera *Bacteroides, Clostridium, Faecalibacterium, Eubacterium, Ruminococcus, Peptococcus, Peptostreptococcus*, and *Bifidobacterium*. Other genera, such as *Escherichia* and *Lactobacillus*, are present to a lesser extent. Species from the genus *Bacteroides* alone constitute about 30% of all bacteria in the gut, suggesting that this genus is especially important in the functioning of the host.

Fungal genera that have been detected in the gut include *Candida, Saccharomyces, Aspergillus, Penicillium, Rhodotorula, Trametes, Pleospora, Sclerotinia, Bullera*, and *Galactomyces*, among others. *Rhodotorula* is most frequently found in individuals with inflammatory bowel disease while *Candida* is most frequently found in individuals with hepatitis B cirrhosis and chronic hepatitis B.

Archaea constitute another large class of gut flora which are important in the metabolism of the bacterial products of fermentation.

A number of types of bacteria, such as *Actinomyces viscosus* and *A. naeslundii*, live in the mouth.

The vaginal microflora consists mostly of various *lactobacillus* species (e.g., *Lactobacillus acidophilus, L. iners, L. crispatus, L. jensenii, L. delbrueckii* and *L. gasseri*).

In certain example embodiments, the target epitopes are present on an allergen. As used herein the term "allergen" may refer to an antigen, microorganism, plant, or product thereof that produces an abnormal immune response in which the immune system fights off a perceived threat that would otherwise be harmless to the body. Allergens can be found in a variety of sources (e.g., animal products, foods, insects, mold spores, plants and chemicals). Allergens can include, but are not limited to dust mite, pollen, spores, poison ivy, poison oak, pet dander, royal jelly, peanuts (a legume), nuts, insect bites or stings, seafood and shellfish.

Method 200 begins at block 205, wherein a set of candidate antigens are generated from an input genome sequence. Turning to FIG. 3, the process of generating a set of candidate peptides from one or more input genome sequences is described in more detail.

Method 205 begin at block 305, where a set of predicted gens is generated from one or more genome input sequences, such as from genomic sequence input files 107. Predicted genes may be identified using various gene prediction methodologies. The gene prediction may be ab initio including both signal-based and content-based approaches. In certain example embodiments, the gene prediction methodology is a hidden Markov model (HMM)-based method, or machine learning based, including neural network based approaches. Example gene prediction algorithms that may be used include, but are not limited to, GLIMMER, GeneMark, GENSCAN, geneid, SNAP, mSplicer, CONTRAST, or GENE. Methods that combine pattern recognition and machine learning such as Maker and Augustus may also be used. Other methods may include comparative genomic approaches, such as those employed by TWINSCAN, N-SCAN, and CONTRAST, may be used. Additional example gene prediction methods are disclosed in Mathe et al. Nucleic Acids Research (2002) 30(19):4103-4117.

At block 310, the gene prediction module 111 then reduces the predicted gene set by selecting only those genes that are identified as producing protein products that are located on the cell surface or are secreted as extracellular proteins. An example method for predicting subcellular localization include PSORTb 3.0 as described in Yu et al. Bioinformatics 26, 1608-1615 (2010). Other similar and known computer-based subcellular localization prediction methods may also be used.

At block 315, the peptide prediction module 111 then takes the sub-set of identified cell-surface and extracellular proteins and mask any intracellular regions and transmembrane domains in the identified subset. Methods for protein topology recognition that may be applied included those described in Tusnady et al. Journal of Molecular Biology 283:489-506 (1998). Similar and other known topology prediction methods may be used. In certain example embodiments, the masked region may be expanded to include a flanking buffer region around the identify intracellular and transmembrane domains. The flanking region may comprise 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 amino acid in either or both of the N- or C-terminal directions from the intracellular region or transmembrane domain. Not being bound by a theory, the flanking region may be differentially accessible based on specific antigens (e.g., antigens in the training set) and the flanking regions either increased or decreased.

At block 320, the peptide prediction module 111, then excludes from further analysis, regions of the candidate proteins that fall within small domains or between a series of domains. The metric used for domain mapping may include the distance to the upstream/downstream domains, the density of flanking domains and the size of the domain. In certain example embodiments, a small domain is a domain of 30 or fewer amino acids. In certain other example embodiments, a region of a candidate protein is excluded if it falls within 8 amino acids of a small domain. In other example embodiments, a region of a candidate protein is excluded if it falls within a series of domains. In certain embodiments, a region of a candidate protein is excluded if it falls within an interdomain region of 20 amino acids or less. Regions of the candidate proteins may be excluded based on one or more of the above criteria. The final result is a data file comprising a list of candidate antigens from each candidate protein. The candidate antigens are those portions of the candidate proteins that remain after all of the exclusion and masking steps above are completed. The candidate antigen data file may be stored in the candidate antigen library 112. The method then returns to block 210 of FIG. 2.

At block 210 of FIG. 2, the epitope ranking module 113 then takes the candidate antigens as input and proceeds to generate a list of ranked candidate epitopes. Many factors contribute to the score for ranking (e.g., MHC binding, cellular localization, protein topology, domain architecture). The process is described in more detail with reference to FIG. 4.

Method 210 begins at block 405 of FIG. 4, wherein the epitope ranking module 113 encodes each amino acid of each candidate antigen into a p-dimensional binary vector b with half of the vector elements being 1 and the rest being 0, chosen at random.

At block 410, the epitope ranking module 113 coverts each a p-dimensional binary vector b into a descriptor matrix S. Therefore, given a peptide with length l longer than k, it is first converted to an l×b descriptor matrix S, in which $S_{ij}=1$ if the i-th amino acid's l-valued indices overlap with j, otherwise $S_{ij}=0$. The matrix S is then normalized by row sum to become S' such that $$S_{ij}'=S_{ij}/\Sigma_{j=1}^{b}S_{ij}$$

At block 415, the epitope ranking module 113 then convolutes S' into a (1−k+1)×d matrix X, where d is the number of pre-trained motif network models within the overall model and k is the length of such binding cores. $X_{ij}$ represents the score of motif network model j aligned to position i. The cohort of motif network models is arranged in a d×k×b array H with $H_{ijk}$ being the d-th motif network model aligned to the k-th position of the b-th set of amino acids. This sequence conversion and convolution setup is similar to model developed by Alipanahi et al. (Alipanahi et al., 2015). Methods for generating pre-trained motif network models are described in further detail below.

At block 420, the epitope ranking module 113 then transforms the scoring matrix X into a d-dimensional vector Z, wherein vector Z is input for neural network analysis and ranking of epitopes. The output of the neural network is a list of scored epitopes. In certain example embodiments, the epitopes may be ranked by immunodominance. In certain example embodiments, the convoluted matrix X, it is filtered with a max-rectified linear unit (ReLU) layer, and the rectified matrix Y is then fed into a max pooling stage to be transformed into d-dimensional vector Z, in which, $$z_j = \max(Y_{1j}, Y_{2j}, \ldots, Y_{nj})$$

This d-dimensional vector Z is then used as input for a neural network with a Maxout dropout model. Z is then used as the input for a standard output layer for final prediction calculation. While not being bound by the following theory, the method minimizes the prediction error as measured 1 by 1-norm distance of all the peptides. In one embodiment, the back propagation with stochastic gradient descent (SGD) method using mini batch size at 64 may be used to reach optimal weights. To train the weights, mouse epitope peptides may be used as a training set of true positive peptides. In silico true negative peptides may also be used as a training set by surveying an equal number of peptides that are not part of the peptidomics data readout at random.

Figure 6:
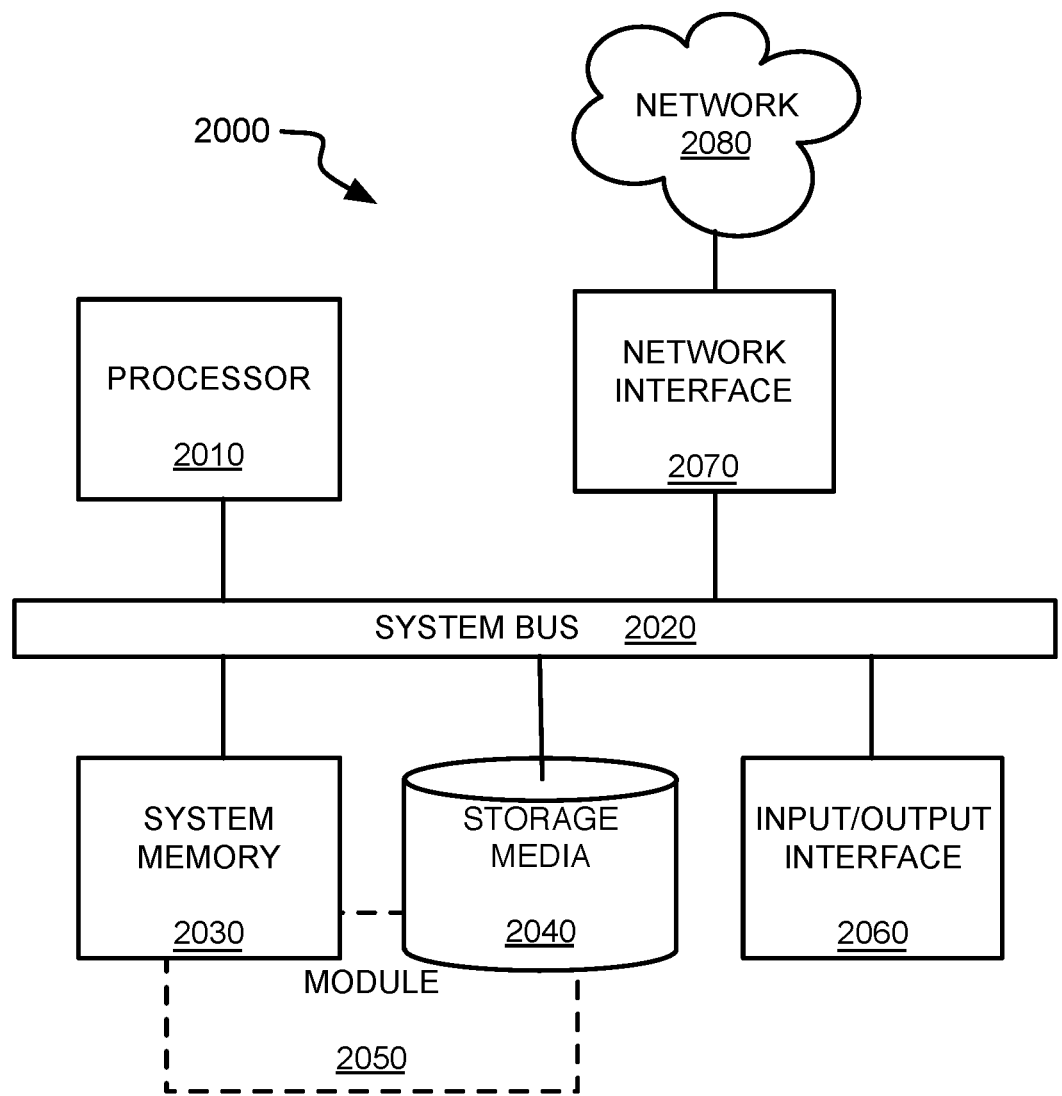
FIG. 6—block diagram depicting a computing machine and a module, in accordance with certain example embodiments.

In one embodiment, a neural network is trained by a method comprising exposing dendritic or antigen presenting cells to a pool of potential binding antigens. In certain embodiments, the pool includes non-self-antigens. In preferred embodiments, the pool of potential antigens is derived from a target pathogen or cell type. Not being bound by a theory, exposure of the dendritic or antigen presenting cells to the target pathogen or cell type allows for the determination of improved binding parameters for MHCII molecules because non-self-binding peptides may bind with higher affinity. The dendritic cells may be lysed and MHCII-peptide complexes may be isolated using an affinity reagent specific for the MHCII molecule. In preferred embodiments, antibodies are used. The antibodies may be bound to a solid support, such as, but not limited to magnetic beads or protein A or G beads. Upon isolation of the MHCII-peptide complexes, the bound peptides may be determined by protein sequencing, such as, but not limited to mass spectrometry or Edman degradation. The peptides may include peptides originating from the target pathogen or cell type and may also include peptides originating from the dendritic cell or antigen presenting host organism. The dendritic cells or antigen presenting cells may originate from a mammalian host organism, such as, but not limited to a human or mouse host organism. The bound peptides may be used for generating detectors in block 230 by testing randomly initialized parameters for the peptides. Such parameters may include, but are not limited to, amino acid sequence or net charge of peptide. The parameters may be tested in a three-fold cross validation scheme. Sets of randomly selected parameters may be tested and the best performing set provided to the deep neural network. In certain embodiments, more than 10, 20, 30, or 40, preferably about 30 parameter sets are constructed. The sets may include more than 10, 20, 30, or 40, preferably about 30 parameters. Based on the parameters most consistent with the identified peptides a set is selected. The optimal parameters may be identified by having the optimal ROC AUC score. The selected training parameters are provided to the deep neural network 116 for predicting unknown binding peptides from a genome sequence. FIG. 6 provides an example experimental work flow for identifying peptides which may then be used to train neural networks in accordance with the embodiments disclosed herein. The experimental work flow is described in greater detail in the Examples below.

Other Example Computer Embodiments

Figure 5:
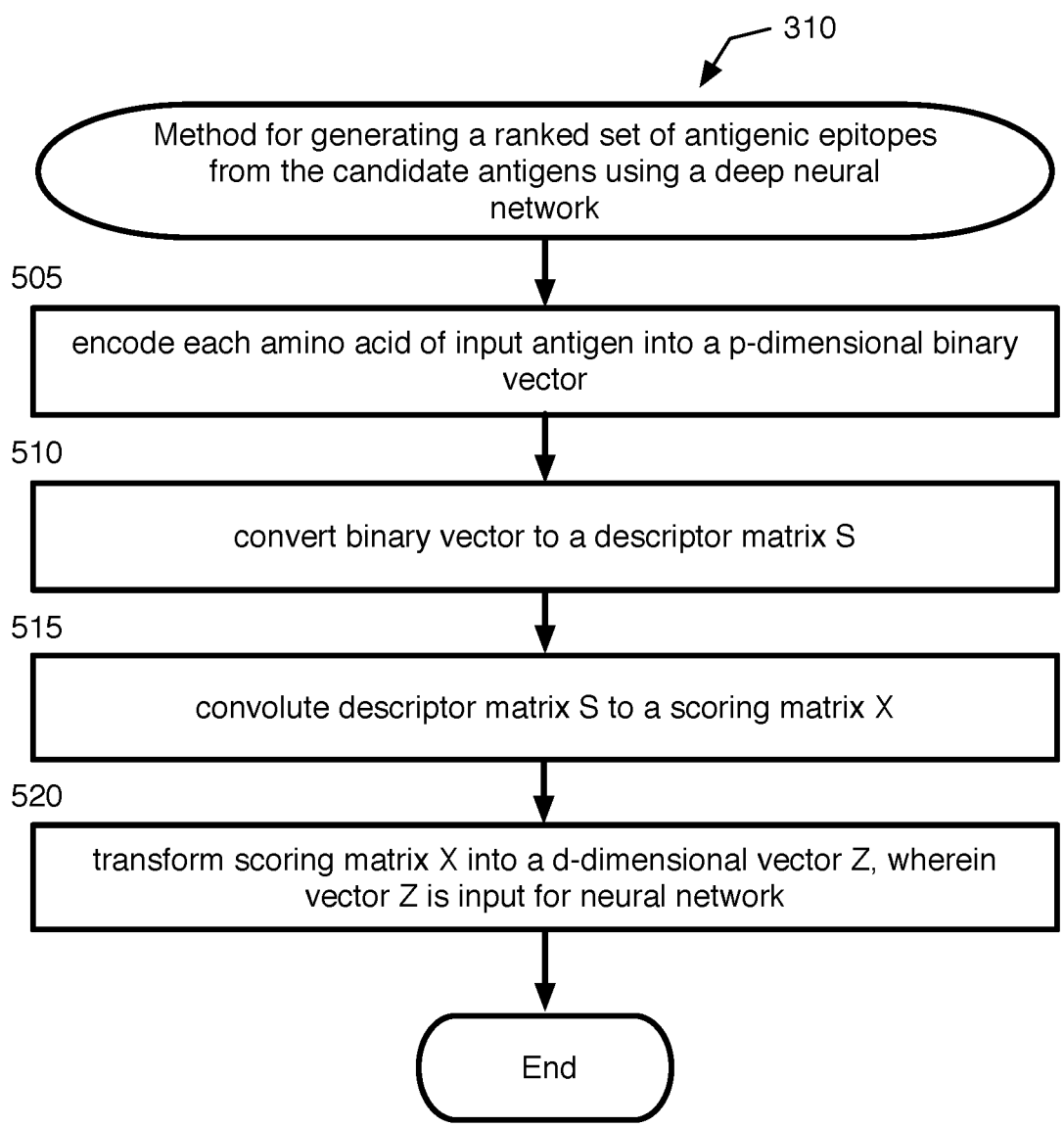
FIG. 5—block diagram depicting a method for generating a ranked set of antigenic epitopes from the candidate antigens using a deep neural network.

FIG. 5 depicts a computing machine 2000 and a module 2050 in accordance with certain example embodiments. The computing machine 2000 may correspond to any of the various computers, servers, mobile devices, embedded systems, or computing systems presented herein. The module 2050 may comprise one or more hardware or software elements configured to facilitate the computing machine 2000 in performing the various methods and processing functions presented herein. The computing machine 2000 may include various internal or attached components such as a processor 2010, system bus 2020, system memory 2030, storage media 2040, input/output interface 2060, and a network interface 2070 for communicating with a network 2080.

The computing machine 2000 may be implemented as a conventional computer system, an embedded controller, a laptop, a server, a mobile device, a smartphone, a set-top box, a kiosk, a vehicular information system, one more processors associated with a television, a customized machine, any other hardware platform, or any combination or multiplicity thereof. The computing machine 2000 may be a distributed system configured to function using multiple computing machines interconnected via a data network or bus system.

The processor 2010 may be configured to execute code or instructions to perform the operations and functionality described herein, manage request flow and address mappings, and to perform calculations and generate commands. The processor 2010 may be configured to monitor and control the operation of the components in the computing machine 2000. The processor 2010 may be a general purpose processor, a processor core, a multiprocessor, a reconfigurable processor, a microcontroller, a digital signal processor ("DSP"), an application specific integrated circuit ("ASIC"), a graphics processing unit ("GPU"), a field programmable gate array ("FPGA"), a programmable logic device ("PLD"), a controller, a state machine, gated logic, discrete hardware components, any other processing unit, or any combination or multiplicity thereof. The processor 2010 may be a single processing unit, multiple processing units, a single processing core, multiple processing cores, special purpose processing cores, co-processors, or any combination thereof. According to certain embodiments, the processor 2010 along with other components of the computing machine 2000 may be a virtualized computing machine executing within one or more other computing machines.

The system memory 2030 may include non-volatile memories such as read-only memory ("ROM"), programmable read-only memory ("PROM"), erasable programmable read-only memory ("EPROM"), flash memory, or any other device capable of storing program instructions or data with or without applied power. The system memory 2030 may also include volatile memories such as random access memory ("RAM"), static random access memory ("SRAM"), dynamic random access memory ("DRAM"), and synchronous dynamic random access memory ("SDRAM"). Other types of RAM also may be used to implement the system memory 2030. The system memory 2030 may be implemented using a single memory module or multiple memory modules. While the system memory 2030 is depicted as being part of the computing machine 2000, one skilled in the art will recognize that the system memory 2030 may be separate from the computing machine 2000 without departing from the scope of the subject technology. It should also be appreciated that the system memory 2030 may include, or operate in conjunction with, a non-volatile storage device such as the storage media 2040.

The storage media 2040 may include a hard disk, a floppy disk, a compact disc read only memory ("CD-ROM"), a digital versatile disc ("DVD"), a Blu-ray disc, a magnetic tape, a flash memory, other non-volatile memory device, a solid state drive ("SSD"), any magnetic storage device, any optical storage device, any electrical storage device, any semiconductor storage device, any physical-based storage device, any other data storage device, or any combination or multiplicity thereof. The storage media 2040 may store one or more operating systems, application programs and program modules such as module 2050, data, or any other information. The storage media 2040 may be part of, or connected to, the computing machine 2000. The storage media 2040 may also be part of one or more other computing machines that are in communication with the computing machine 2000 such as servers, database servers, cloud storage, network attached storage, and so forth.

The module 2050 may comprise one or more hardware or software elements configured to facilitate the computing machine 2000 with performing the various methods and processing functions presented herein. The module 2050 may include one or more sequences of instructions stored as software or firmware in association with the system memory 2030, the storage media 2040, or both. The storage media 2040 may therefore represent examples of machine or computer readable media on which instructions or code may be stored for execution by the processor 2010. Machine or computer readable media may generally refer to any medium or media used to provide instructions to the processor 2010. Such machine or computer readable media associated with the module 2050 may comprise a computer software product. It should be appreciated that a computer software product comprising the module 2050 may also be associated with one or more processes or methods for delivering the module 2050 to the computing machine 2000 via the network 2080, any signal-bearing medium, or any other communication or delivery technology. The module 2050 may also comprise hardware circuits or information for configuring hardware circuits such as microcode or configuration information for an FPGA or other PLD.

The input/output ("I/O") interface 2060 may be configured to couple to one or more external devices, to receive data from the one or more external devices, and to send data to the one or more external devices. Such external devices along with the various internal devices may also be known as peripheral devices. The I/O interface 2060 may include both electrical and physical connections for operably coupling the various peripheral devices to the computing machine 2000 or the processor 2010. The I/O interface 2060 may be configured to communicate data, addresses, and control signals between the peripheral devices, the computing machine 2000, or the processor 2010. The I/O interface 2060 may be configured to implement any standard interface, such as small computer system interface ("SCSI"), serial-attached SCSI ("SAS"), fiber channel, peripheral component interconnect ("PCI"), PCI express (PCIe), serial bus, parallel bus, advanced technology attached ("ATA"), serial ATA ("SATA"), universal serial bus ("USB"), Thunderbolt, FireWire, various video buses, and the like. The I/O interface 2060 may be configured to implement only one interface or bus technology. Alternatively, the I/O interface 2060 may be configured to implement multiple interfaces or bus technologies. The I/O interface 2060 may be configured as part of, all of, or to operate in conjunction with, the system bus 2020. The I/O interface 2060 may include one or more buffers for buffering transmissions between one or more external devices, internal devices, the computing machine 2000, or the processor 2010.

The I/O interface 2060 may couple the computing machine 2000 to various input devices including mice, touch-screens, scanners, biometric readers, electronic digitizers, sensors, receivers, touchpads, trackballs, cameras, microphones, keyboards, any other pointing devices, or any combinations thereof. The I/O interface 2060 may couple the computing machine 2000 to various output devices including video displays, speakers, printers, projectors, tactile feedback devices, automation control, robotic components, actuators, motors, fans, solenoids, valves, pumps, transmitters, signal emitters, lights, and so forth.

The computing machine 2000 may operate in a networked environment using logical connections through the network interface 2070 to one or more other systems or computing machines across the network 2080. The network 2080 may include wide area networks (WAN), local area networks (LAN), intranets, the Internet, wireless access networks, wired networks, mobile networks, telephone networks, optical networks, or combinations thereof. The network 2080 may be packet switched, circuit switched, of any topology, and may use any communication protocol. Communication links within the network 2080 may involve various digital or an analog communication media such as fiber optic cables, free-space optics, waveguides, electrical conductors, wireless links, antennas, radio-frequency communications, and so forth.

The processor 2010 may be connected to the other elements of the computing machine 2000 or the various peripherals discussed herein through the system bus 2020. It should be appreciated that the system bus 2020 may be within the processor 2010, outside the processor 2010, or both. According to some embodiments, any of the processor 2010, the other elements of the computing machine 2000, or the various peripherals discussed herein may be integrated into a single device such as a system on chip ("SOC"), system on package ("SOP"), or ASIC device.

Embodiments may comprise a computer program that embodies the functions described and illustrated herein, wherein the computer program is implemented in a computer system that comprises instructions stored in a machine-readable medium and a processor that executes the instructions. However, it should be apparent that there could be many different ways of implementing embodiments in computer programming, and the embodiments should not be construed as limited to any one set of computer program instructions. Further, a skilled programmer would be able to write such a computer program to implement an embodiment of the disclosed embodiments based on the appended flow charts and associated description in the application text. Therefore, disclosure of a particular set of program code instructions is not considered necessary for an adequate understanding of how to make and use embodiments. Further, those skilled in the art will appreciate that one or more aspects of embodiments described herein may be performed by hardware, software, or a combination thereof, as may be embodied in one or more computing systems. Moreover, any reference to an act being performed by a computer should not be construed as being performed by a single computer as more than one computer may perform the act.

The example embodiments described herein can be used with computer hardware and software that perform the methods and processing functions described herein. The systems, methods, and procedures described herein can be embodied in a programmable computer, computer-executable software, or digital circuitry. The software can be stored on computer-readable media. For example, computer-readable media can include a floppy disk, RAM, ROM, hard disk, removable media, flash memory, memory stick, optical media, magneto-optical media, CD-ROM, etc. Digital circuitry can include integrated circuits, gate arrays, building block logic, field programmable gate arrays (FPGA), etc.

Immunogenic Compositions

The present invention provides for predicting MHCII binding epitopes useful in formulating an immunogenic composition. The immunogenic composition may be used in the treatment of a patient in need thereof. The immunogenic composition may be a protective or tolerizing vaccine. In preferred embodiments, the immunogenic composition activates CD4+ T cells to generate a humoral immune response. In certain embodiments, the peptides enhance a CD8+ CTL response. A tolerizing vaccine may be formulated with antigenic epitopes specific for an allergen or for an autoimmunity antigen. A protective vaccine may be formulated with antigenic epitopes specific for a pathogen or for a cancer cell.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The immune system can be classified into two functional subsystems: the innate and the acquired immune system. The innate immune system is the first line of defense against infections, and most potential pathogens are rapidly neutralized by this system before they can cause, for example, a noticeable infection. The acquired immune system reacts to molecular structures, referred to as antigens, of the intruding organism. There are two types of acquired immune reactions, which include the humoral immune reaction and the cell-mediated immune reaction. In the humoral immune reaction, antibodies secreted by B cells into bodily fluids bind to pathogen-derived antigens, leading to the elimination of the pathogen through a variety of mechanisms, e.g. complement-mediated lysis. In the cell-mediated immune reaction, T-cells capable of destroying other cells are activated. For example, if proteins associated with a disease are present in a cell, they are fragmented proteolytically to peptides within the cell. Specific cell proteins then attach themselves to the antigen or peptide formed in this manner and transport them to the surface of the cell, where they are presented to the molecular defense mechanisms, in particular T-cells, of the body. Cytotoxic T cells recognize these antigens and kill the cells that harbor the antigens.

The molecules that transport and present peptides on the cell surface are referred to as proteins of the major histocompatibility complex (MHC). MHC proteins are classified into two types, referred to as MHC class I and MHC class II. The structures of the proteins of the two MHC classes are very similar; however, they have very different functions. Proteins of MHC class I are present on the surface of almost all cells of the body, including most tumor cells. MHC class I proteins are loaded with antigens that usually originate from endogenous proteins or from pathogens present inside cells, and are then presented to naïve or cytotoxic T-lymphocytes (CTLs). MHC class II proteins are present on dendritic cells (DC), B-lymphocytes, macrophages and other antigen-presenting cells (APC). They mainly present peptides, which are processed from external antigen sources, i.e. outside of the cells, to T-helper (Th) cells.

Most of the peptides bound by the MHC class I proteins originate from cytoplasmic proteins produced in the healthy host cells of an organism itself, and do not normally stimulate an immune reaction. Accordingly, cytotoxic T-lymphocytes that recognize such self-peptide-presenting MHC molecules of class I are deleted in the thymus (central tolerance) or, after their release from the thymus, are deleted or inactivated, i.e. tolerized (peripheral tolerance). MHC molecules are capable of stimulating an immune reaction when they present peptides to non-tolerized T-lymphocytes. Cytotoxic T-lymphocytes have both T-cell receptors (TCR) and CD8 molecules on their surface. T-Cell receptors are capable of recognizing and binding peptides complexed with the molecules of MHC class I. Each cytotoxic T-lymphocyte expresses a unique T-cell receptor which is capable of binding specific MHC/peptide complexes.

MHC Class II molecules are required for the activation of CD4+ T cells. CD4+ T cells depend mainly on infiltrating APCs that either pick up available antigens or engulf tumor cells or pathogens. The MHC Class II antigen presentation pathway can be targeted in an immunotherapy (see e.g., Thibodeau, et al., Targeting the MHC Class II antigen presentation pathway in cancer immunotherapy. Oncoimmunology. 2012 Sep. 1; 1(6):908-916). Antigens can gain access to MHC Class II-loading compartments by multiple distinct means. For example, transmembrane proteins from the plasma membrane can be endocytosed and sent to lysosomes for degradation. Phagocytosis is also a mechanism antigens can gain access to MHC Class II loading compartments. For example, when a macrophage ingests a pathogenic microorganism, or cancer cell the pathogen or cancer cell becomes trapped in a phagosome which then fuses with a lysosome to form a phagolysosome. Within the phagolysosome, enzymes and toxic peroxides digest the pathogen or cancer cell. Cytoplasmic and nuclear antigens can also be engulfed by autophagy.

In certain embodiments, a subject is administered an immunogenic composition comprising the antigenic epitopes of the present invention. In one embodiment, the peptides of the present invention are administered to a subject in need thereof.

In one embodiment, the immunogenic composition comprises natural or artificial APCs that have been manipulated in vitro to display the antigens of the present invention. DCs are potent antigen-presenting cells that initiate T cell immunity and can be used as vaccines when loaded with one or more peptides of interest, for example, by direct peptide injection. The dendritic cells may be isolated from peripheral blood by means of leukapheresis. They may be cultured in vitro with the cytokines GM-CSF and interleukin-4, loaded with antigen, and matured ex vivo to enhance antigen presentation and costimulation of T-cells before being injected into patients. Antigen may be delivered to DCs as peptide, protein, or RNA. B cells may also serve as efficient APCs for the expansion of antigen specific CD4+ T cells. B cells can present MHC Class II epitopes when pulsed exogenously and can also promote MHC Class I cross-presentation. Antigenic epitopes may also be presented by acellular artificial APCs that consist of microbeads, liposomes or exosomes.

It is contemplated within the scope of the invention that antigen loaded DCs may be prepared using the synthetic TLR 3 agonist Polyinosinic-Polycytidylic Acid-poly-L-lysine Carboxymethylcellulose (Poly-ICLC) to stimulate the DCs. Poly-ICLC is a potent individual maturation stimulus for human DCs as assessed by an upregulation of CD83 and CD86, induction of interleukin-12 (IL-12), tumor necrosis factor (TNF), interferon gamma-induced protein 10 (IP-10), interleukin 1 (IL-1), and type I interferons (IFN), and minimal interleukin 10 (IL-10) production. DCs may be differentiated from frozen peripheral blood mononuclear cells (PBMCs) obtained by leukapheresis, while PBMCs may be isolated by Ficoll gradient centrifugation and frozen in aliquots.

Illustratively, the following 7 day activation protocol may be used. Day 1-PBMCs are thawed and plated onto tissue culture flasks to select for monocytes which adhere to the plastic surface after 1-2 hr incubation at 37° C. in the tissue culture incubator. After incubation, the lymphocytes are washed off and the adherent monocytes are cultured for 5 days in the presence of interleukin-4 (IL-4) and granulocyte macrophage-colony stimulating factor (GM-CSF) to differentiate to immature DCs. On Day 6, immature DCs are pulsed with the keyhole limpet hemocyanin (KLH) protein which serves as a control for the quality of the vaccine and may boost the immunogenicity of the vaccine. The DCs are stimulated to mature, loaded with peptide antigens, and incubated overnight. On Day 7, the cells are washed, and frozen in 1 ml aliquots containing $4$-$20 \times 10^6$ cells using a controlled-rate freezer. Lot release testing for the batches of DCs may be performed to meet minimum specifications before the DCs are injected into patients (see e.g., Sabado et al. (2013) Preparation of tumor antigen-loaded mature dendritic cells for immunotherapy, J. Vis Exp. August 1; (78). doi: 10.3791/50085).

Thus, in one embodiment of the present invention the vaccine or immunogenic composition containing at least one antigen presenting cell is pulsed or loaded with one or more peptides of the present invention. Alternatively, peripheral blood mononuclear cells (PBMCs) isolated from a patient may be loaded with peptides ex vivo and injected back into the patient. As an alternative the antigen presenting cell comprises an expression construct encoding a peptide of the present invention. The polynucleotide may be any suitable polynucleotide and it is preferred that it is capable of transducing the dendritic cell, thus resulting in the presentation of a peptide and induction of immunity.

In another embodiment, the immunogenic composition comprises recombinant antigens coupled to monoclonal antibodies directed against DC surface receptors.

Amounts effective for an immunogenic composition can depend on, e.g., the peptide composition, the manner of administration, the stage and severity of the disease being treated, the weight and general state of health of the patient, and the judgment of the prescribing physician, but generally range for the initial immunization (that is for therapeutic or prophylactic administration) from about 1.0 μg to about 50,000 μg of peptide for a 70 kg patient, followed by boosting dosages or from about 1.0 μg to about 10,000 μg of peptide pursuant to a boosting regimen over weeks to months depending upon the patient's response and condition.

The pharmaceutical compositions (e.g., vaccine compositions) for therapeutic treatment are intended for parenteral, topical, nasal, oral or local administration. Preferably, the pharmaceutical compositions are administered parenterally, e.g., intravenously, subcutaneously, intradermally, or intramuscularly. The compositions may be administered at the site of surgical excision to induce a local immune response to the tumor. The invention provides compositions for parenteral administration which comprise a solution of the peptides and vaccine or immunogenic compositions are dissolved or suspended in an acceptable carrier, preferably an aqueous carrier. A variety of aqueous carriers may be used, e.g., water, buffered water, 0.9% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may contain pharmaceutically acceptable auxiliary substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc.

A liposome suspension containing a peptide may be administered intravenously, locally, topically, etc. in a dose which varies according to, inter alia, the manner of administration, the peptide being delivered, and the stage of the disease being treated. For targeting to the immune cells, a ligand, such as, e.g., antibodies or fragments thereof specific for cell surface determinants of the desired immune system cells, can be incorporated into the liposome.

For solid compositions, conventional or nanoparticle nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, the immunogenic peptides are preferably supplied in finely divided form along with a surfactant and propellant. Typical percentages of peptides are 0.01%-20% by weight, preferably 1%-10%. The surfactant can, of course, be nontoxic, and preferably soluble in the propellant. Representative of such agents are the esters or partial esters of fatty acids containing from 6 to 22 carbon atoms, such as caproic, octanoic, lauric, palmitic, stearic, linoleic, linolenic, cholesteric and oleic acids with an aliphatic polyhydric alcohol or its cyclic anhydride. Mixed esters, such as mixed or natural glycerides may be employed. The surfactant may constitute 0.1%-20% by weight of the composition, preferably 0.25-5%. The balance of the composition is ordinarily propellant. A carrier can also be included as desired, as with, e.g., lecithin for intranasal delivery.

As described in further detail herein, in vitro production of antigenic peptides may occur by a variety of methods known to one of skill in the art such as, for example, peptide synthesis or expression of a peptide/polypeptide from a DNA or RNA molecule in any of a variety of bacterial, eukaryotic, or viral recombinant expression systems, followed by purification of the expressed peptide/polypeptide. Alternatively, antigenic peptides may be produced in vivo by introducing molecules (e.g., DNA, RNA, viral expression systems, and the like) that encode antigenic peptides into a subject, whereupon the encoded antigenic peptides are expressed.

Peptides can be readily synthesized chemically utilizing reagents that are free of contaminating bacterial or animal substances (Merrifield R B: Solid phase peptide synthesis. I. The synthesis of a tetrapeptide. J. Am. Chem. Soc. 85:2149-54, 1963). In certain embodiments, antigenic peptides are prepared by (1) parallel solid-phase synthesis on multichannel instruments using uniform synthesis and cleavage conditions; (2) purification over a RP-HPLC column with column stripping; and re-washing, but not replacement, between peptides; followed by (3) analysis with a limited set of the most informative assays. Synthetic peptides provide a particularly useful means to prepare multiple immunogens efficiently and to rapidly translate identification of mutant epitopes to an effective vaccine or immunogenic composition. Peptides can be readily synthesized chemically and easily purified utilizing reagents free of contaminating bacteria or animal substances. The small size allows a clear focus on the mutated region of the protein and also reduces irrelevant antigenic competition from other components (unmutated protein or viral vector antigens).

In one embodiment, the drug formulation is a multi-epitope vaccine or immunogenic composition of long peptides. Such "long" peptides undergo efficient internalization, processing and cross-presentation in professional antigen-presenting cells such as dendritic cells, and have been shown to induce CTLs in humans (Melief and van der Burg, Immunotherapy of established (pre) malignant disease by synthetic long peptide vaccines Nature Rev Cancer 8:351 (2008)). In one embodiment, at least 1 peptide is prepared for immunization. In a preferred embodiment 20 or more peptides are prepared for immunization. In one embodiment, the neoantigenic peptide ranges from about 5 to about 50 amino acids in length. In another embodiment peptides from about 15 to about 35 amino acids in length is synthesized. In preferred embodiments, the peptide ranges from about 20 to about 35 amino acids in length.

The vaccine or immunogenic composition can further comprise an adjuvant and/or a carrier. Examples of useful adjuvants and carriers are given herein. The peptides and/or polypeptides in the composition can be associated with a carrier such as, e.g., a protein or an antigen-presenting cell such as e.g. a dendritic cell (DC) capable of presenting the peptide to a T-cell.

Vaccine or Immunogenic Composition Adjuvant

Adjuvants are any substance whose admixture into the vaccine or immunogenic composition increases or otherwise modifies the immune response to the mutant peptide. Carriers are scaffold structures, for example a polypeptide or a polysaccharide, to which the neoantigenic peptides, is capable of being associated. Optionally, adjuvants are conjugated covalently or non-covalently to the peptides or polypeptides of the invention.

The ability of an adjuvant to increase the immune response to an antigen is typically manifested by a significant increase in immune-mediated reaction, or reduction in disease symptoms. For example, an increase in humoral immunity is typically manifested by a significant increase in the titer of antibodies raised to the antigen, and an increase in T-cell activity is typically manifested in increased cell proliferation, or cellular cytotoxicity, or cytokine secretion. An adjuvant may also alter an immune response, for example, by changing a primarily humoral or Th2 response into a primarily cellular, or Th1 response.

Effective vaccine or immunogenic compositions advantageously include a strong adjuvant to initiate an immune response. As described herein, poly-ICLC, an agonist of TLR3 and the RNA helicase-domains of MDA5 and RIG3, has shown several desirable properties for a vaccine or immunogenic composition adjuvant. These properties include the induction of local and systemic activation of immune cells in vivo, production of stimulatory chemokines and cytokines, and stimulation of antigen-presentation by DCs. Furthermore, poly-ICLC can induce durable CD4+ and CD8+ responses in humans. Importantly, striking similarities in the up regulation of transcriptional and signal transduction pathways were seen in subjects vaccinated with poly-ICLC and in volunteers who had received the highly effective, replication-competent yellow fever vaccine. Furthermore, >90% of ovarian carcinoma patients immunized with poly-ICLC in combination with a NY-ESO-1 peptide vaccine (in addition to Montanide) showed induction of CD4+ and CD8+ T cell, as well as antibody responses to the peptide in a recent phase 1 study. At the same time, poly-ICLC has been extensively tested in more than 25 clinical trials to date and exhibited a relatively benign toxicity profile. In addition to a powerful and specific immunogen the neoantigen peptides may be combined with an adjuvant (e.g., poly-ICLC) or another anti-neoplastic agent. Without being bound by theory, these neoantigens are expected to bypass central thymic tolerance (thus allowing stronger antitumor T cell response), while reducing the potential for autoimmunity (e.g., by avoiding targeting of normal self-antigens). An effective immune response advantageously includes a strong adjuvant to activate the immune system (Speiser and Romero, Molecularly defined vaccines for cancer immunotherapy, and protective T cell immunity Seminars in Immunol 22:144 (2010)). For example, Toll-like receptors (TLRs) have emerged as powerful sensors of microbial and viral pathogen "danger signals", effectively inducing the innate immune system, and in turn, the adaptive immune system (Bhardwaj and Gnjatic, TLR AGONISTS: Are They Good Adjuvants? Cancer J. 16:382-391 (2010)). Among the TLR agonists, poly-ICLC (a synthetic double-stranded RNA mimic) is one of the most potent activators of myeloid-derived dendritic cells. In a human volunteer study, poly-ICLC has been shown to be safe and to induce a gene expression profile in peripheral blood cells comparable to that induced by one of the most potent live attenuated viral vaccines, the yellow fever vaccine YF-17D (Caskey et al, Synthetic double-stranded RNA induces innate immune responses similar to a live viral vaccine in humans J Exp Med 208:2357 (2011)). In a preferred embodiment Hiltonol®, a GMP preparation of poly-ICLC prepared by Oncovir, Inc, is utilized as the adjuvant. In other embodiments, other adjuvants described herein are envisioned. For instance oil-in-water, water-in-oil or multiphasic W/O/W; see, e.g., U.S. Pat. No. 7,608,279 and Aucouturier et al, Vaccine 19 (2001), 2666-2672, and documents cited therein.

Adjuvants are any substance whose admixture into the vaccine or immunogenic composition increases or otherwise modifies the immune response to the mutant peptide. Carriers are scaffold structures, for example a polypeptide or a polysaccharide, to which the neoantigenic peptides, is capable of being associated. Optionally, adjuvants are conjugated covalently or non-covalently to the peptides or polypeptides of the invention.

The ability of an adjuvant to increase the immune response to an antigen is typically manifested by a significant increase in immune-mediated reaction, or reduction in disease symptoms. For example, an increase in humoral immunity is typically manifested by a significant increase in the titer of antibodies raised to the antigen, and an increase in T-cell activity is typically manifested in increased cell proliferation, or cellular cytotoxicity, or cytokine secretion. An adjuvant may also alter an immune response, for example, by changing a primarily humoral or Th2 response into a primarily cellular, or Th1 response.

Suitable adjuvants include, but are not limited to 1018 ISS, aluminum salts, Amplivax, AS15, BCG, CP-870,893, CpG7909, CyaA, dSLIM, GM-CSF, IC30, IC31, Imiquimod, ImuFact IMP321, IS Patch, ISS, ISCOMATRIX, Juvlmmune, LipoVac, MF59, monophosphoryl lipid A, Montanide IMS 1312, Montanide ISA 206, Montanide ISA 50V, Montanide ISA-51, OK-432, OM-174, OM-197-MP-EC, ONTAK, PEPTEL. vector system, PLG microparticles, resiquimod, SRL172, Virosomes and other Virus-like particles, YF-17D, VEGF trap, R848, beta-glucan, Pam3Cys, Aquila's QS21 stimulon (Aquila Biotech, Worcester, Mass., USA) which is derived from saponin, mycobacterial extracts and synthetic bacterial cell wall mimics, and other proprietary adjuvants such as Ribi's Detox, Quil or Superfos. Several immunological adjuvants (e.g., MF59) specific for dendritic cells and their preparation have been described previously (Dupuis M, et al., Cell Immunol. 1998; 186 (1): 18-27; Allison A C; Dev Biol Stand. 1998; 92:3-11). Also cytokines may be used. Several cytokines have been directly linked to influencing dendritic cell migration to lymphoid tissues (e.g., TNF-alpha), accelerating the maturation of dendritic cells into efficient antigen-presenting cells for T-lymphocytes (e.g., GM-CSF, IL-1 and IL-4) (U.S. Pat. No. 5,849,589, specifically incorporated herein by reference in its entirety) and acting as immunoadjuvants (e.g., IL-12) (Gabrilovich D I, et al., J Immunother Emphasis Tumor Immunol. 1996 (6):414-418).

Toll like receptors (TLRs) may also be used as adjuvants, and are important members of the family of pattern recognition receptors (PRRs) which recognize conserved motifs shared by many micro-organisms, termed "pathogen-associated molecular patterns" (PAMPS). Recognition of these "danger signals" activates multiple elements of the innate and adaptive immune system. TLRs are expressed by cells of the innate and adaptive immune systems such as dendritic cells (DCs), macrophages, T and B cells, mast cells, and granulocytes and are localized in different cellular compartments, such as the plasma membrane, lysosomes, endosomes, and endolysosomes. Different TLRs recognize distinct PAMPS. For example, TLR4 is activated by LPS contained in bacterial cell walls, TLR9 is activated by unmethylated bacterial or viral CpG DNA, and TLR3 is activated by double stranded RNA. TLR ligand binding leads to the activation of one or more intracellular signaling pathways, ultimately resulting in the production of many key molecules associated with inflammation and immunity (particularly the transcription factor NF-κB and the Type-I interferons). TLR mediated DC activation leads to enhanced DC activation, phagocytosis, upregulation of activation and costimulation markers such as CD80, CD83, and CD86, expression of CCR7 allowing migration of DC to draining lymph nodes and facilitating antigen presentation to T cells, as well as increased secretion of cytokines such as type I interferons, IL-12, and IL-6. All of these downstream events are critical for the induction of an adaptive immune response.

Among the most promising cancer vaccine or immunogenic composition adjuvants currently in clinical development are the TLR9 agonist CpG and the synthetic double-stranded RNA (dsRNA) TLR3 ligand poly-ICLC. In preclinical studies poly-ICLC appears to be the most potent TLR adjuvant when compared to LPS and CpG due to its induction of pro-inflammatory cytokines and lack of stimulation of IL-10, as well as maintenance of high levels of co-stimulatory molecules in DCs1. Furthermore, poly-ICLC was recently directly compared to CpG in non-human primates (rhesus macaques) as adjuvant for a protein vaccine or immunogenic composition consisting of human papillomavirus (HPV) 16 capsomeres (Stahl-Hennig C, Eisenblatter M, Jasny E, et al. Synthetic double-stranded RNAs are adjuvants for the induction of T helper 1 and humoral immune responses to human papillomavirus in rhesus macaques. PLOS pathogens. April 2009; 5 (4)).

CpG immuno stimulatory oligonucleotides have also been reported to enhance the effects of adjuvants in a vaccine or immunogenic composition setting. Without being bound by theory, CpG oligonucleotides act by activating the innate (non-adaptive) immune system via Toll-like receptors (TLR), mainly TLR9. CpG triggered TLR9 activation enhances antigen-specific humoral and cellular responses to a wide variety of antigens, including peptide or protein antigens, live or killed viruses, dendritic cell vaccines, autologous cellular vaccines and polysaccharide conjugates in both prophylactic and therapeutic vaccines. More importantly, it enhances dendritic cell maturation and differentiation, resulting in enhanced activation of Th1 cells and strong cytotoxic T-lymphocyte (CTL) generation, even in the absence of CD4 T-cell help. The Th1 bias induced by TLR9 stimulation is maintained even in the presence of vaccine adjuvants such as alum or incomplete Freund's adjuvant (IFA) that normally promote a Th2 bias. CpG oligonucleotides show even greater adjuvant activity when formulated or co-administered with other adjuvants or in formulations such as microparticles, nano particles, lipid emulsions or similar formulations, which are especially necessary for inducing a strong response when the antigen is relatively weak. They also accelerate the immune response and enabled the antigen doses to be reduced by approximately two orders of magnitude, with comparable antibody responses to the full-dose vaccine without CpG in some experiments (Arthur M. Krieg, Nature Reviews, Drug Discovery, 5, June 2006, 471-484). U.S. Pat. No. 6,406,705 B1 describes the combined use of CpG oligonucleotides, non-nucleic acid adjuvants and an antigen to induce an antigen-specific immune response. A commercially available CpG TLR9 antagonist is dSLIM (double Stem Loop Immunomodulator) by Mologen (Berlin, GERMANY), which is a preferred component of the pharmaceutical composition of the present invention. Other TLR binding molecules such as RNA binding TLR 7, TLR 8 and/or TLR 9 may also be used.

Other examples of useful adjuvants include, but are not limited to, chemically modified CpGs (e.g. CpR, Idera), Poly(I:C) (e.g. polyi:CI2U), non-CpG bacterial DNA or RNA as well as immunoactive small molecules and antibodies such as cyclophosphamide, sunitinib, bevacizumab, celebrex, NCX-4016, sildenafil, tadalafil, vardenafil, sorafenib, XL-999, CP-547632, pazopanib, ZD2171, AZD2171, ipilimumab, tremelimumab, and SC58175, which may act therapeutically and/or as an adjuvant. The amounts and concentrations of adjuvants and additives useful in the context of the present invention can readily be determined by the skilled artisan without undue experimentation. Additional adjuvants include colony-stimulating factors, such as Granulocyte Macrophage Colony Stimulating Factor (GM-CSF, sargramostim).

Poly-ICLC is a synthetically prepared double-stranded RNA consisting of polyI and polyC strands of average length of about 5000 nucleotides, which has been stabilized to thermal denaturation and hydrolysis by serum nucleases by the addition of polylysine and carboxymethylcellulose. The compound activates TLR3 and the RNA helicase-domain of MDA5, both members of the PAMP family, leading to DC and natural killer (NK) cell activation and production of a "natural mix" of type I interferons, cytokines, and chemokines. Furthermore, poly-ICLC exerts a more direct, broad host-targeted anti-infectious and possibly antitumor effect mediated by the two IFN-inducible nuclear enzyme systems, the 2'5'-OAS and the P1/eIF2a kinase, also known as the PKR (4-6), as well as RIG-I helicase and MDA5.

In rodents and non-human primates, poly-ICLC was shown to enhance T cell responses to viral antigens, cross-priming, and the induction of tumor-, virus-, and autoantigen-specific CD8+ T-cells. In a recent study in non-human primates, poly-ICLC was found to be essential for the generation of antibody responses and T-cell immunity to DC targeted or non-targeted HIV Gag p24 protein, emphasizing its effectiveness as a vaccine adjuvant.

In human subjects, transcriptional analysis of serial whole blood samples revealed similar gene expression profiles among the 8 healthy human volunteers receiving one single s.c. administration of poly-ICLC and differential expression of up to 212 genes between these 8 subjects versus 4 subjects receiving placebo. Remarkably, comparison of the poly-ICLC gene expression data to previous data from volunteers immunized with the highly effective yellow fever vaccine YF17D showed that a large number of transcriptional and signal transduction canonical pathways, including those of the innate immune system, were similarly upregulated at peak time points.

More recently, an immunologic analysis was reported on patients with ovarian, fallopian tube, and primary peritoneal cancer in second or third complete clinical remission who were treated on a phase 1 study of subcutaneous vaccination with synthetic overlapping long peptides (OLP) from the cancer testis antigen NY-ESO-1 alone or with Montanide-ISA-51, or with 1.4 mg poly-ICLC and Montanide. The generation of NY-ESO-1-specific CD4+ and CD8+ T-cell and antibody responses were markedly enhanced with the addition of poly-ICLC and Montanide compared to OLP alone or OLP and Montanide.

Lot release testing for the batches of DCs may be performed to meet minimum specifications before the DCs are injected into patients (see e.g., Sabado et al. (2013) Preparation of tumor antigen-loaded mature dendritic cells for immunotherapy, J. Vis Exp. August 1; (78). doi: 10.3791/50085).

Indications

In one embodiment, the subject is suffering from a neoplasia selected from the group consisting of: Non-Hodgkin's Lymphoma (NHL), clear cell Renal Cell Carcinoma (ccRCC), melanoma, sarcoma, leukemia or a cancer of the bladder, colon, brain, breast, head and neck, endometrium, lung, ovary, pancreas and prostate.

In one embodiment, the subject is suffering from an autoimmune disease selected from the group consisting of: celiac disease, diabetes mellitus type 1, Graves' disease, inflammatory bowel disease, multiple sclerosis, psoriasis, rheumatoid arthritis, and systemic lupus erythematosus.

In one embodiment, the subject is suffering from a bacterial disease or is at risk of contracting a bacterial disease selected from the group consisting of the genus's: *Bacillus, Bartonella, Bordetella, Borrelia, Brucella, Campylobacter, Chlamydia* and *Chlamydophila, Clostridium, Corynebacterium, Enterococcus, Escherichia, Francisella, Haemophilus, Helicobacter, Legionella, Leptospira, Listeria, Mycobacterium, Mycoplasma, Neisseria, Pseudomonas, Rickettsia, Salmonella, Shigella, Staphylococcus, Streptococcus, Treponema, Ureaplasma, Vibrio,* and *Yersinia.*

In one embodiment, the subject is suffering from a viral disease or is at risk of contracting a viral disease selected from the group consisting of the families: Adenoviridae, Picornaviridae, Herpesviridae, Hepadnaviridae, Flaviviridae, Retroviridae, Orthomyxoviridae, Paramyxoviridae, Papovaviridae, Polyomavirus, Rhabdoviridae, and Togaviridae.

In one embodiment, the subject is suffering from a protozoan disease or is at risk of contracting a protozoan disease, such as, but not limited to malaria.

Epitope Prediction Coupled with TCR Profiling

In certain example embodiments, the epitope identification methods disclosed herein may be coupled with TCR profiling to derive antigen-specific therapeutics tailored to the immunodominance of a particular epitope. For example, the methods disclosed herein may be used to derive protective vaccines as well as tolerizing vaccines that induce or more limited immune response than a protective vaccine. A sample to be analyzed is obtained. The sample may originate from a patient to be treated or may be representative of a condition to be treated. The sample may be derived from a biological sample or a biopsy sample depending on the nature of the disease to be addressed. The sample may be an infectious disease sample, a cancer tumor sample, or may be derived from inflamed tissues associated with inflammatory disease, autoimmunity, or allergies. A portion of the sample may be used to derive an input genomic sequence for epitope identification in accordance with the methods described above. In addition, the sample may be used for tissue profiling analysis, such as tissue transcriptome, metatranscriptome, or tumor transcriptome analysis to identify the cell types and/or cell states present in the sample.

Transcriptome analysis may be carried out using known methods in the art. For example, the transcriptome analysis may involve high-throughput single-cell RNA-seq and/or targeted nucleic acid profiling (for example, sequencing, quantitative reverse transcription polymerase chain reaction, and the like).

In certain embodiments, the invention involves single cell RNA sequencing (see, e.g., Kalisky, T., Blainey, P. & Quake, S. R. Genomic Analysis at the Single-Cell Level. Annual review of genetics 45, 431-445, (2011); Kalisky, T. & Quake, S. R. Single-cell genomics. Nature Methods 8, 311-314 (2011); Islam, S. et al. Characterization of the single-cell transcriptional landscape by highly multiplex RNA-seq. Genome Research, (2011); Tang, F. et al. RNA-Seq analysis to capture the transcriptome landscape of a single cell. Nature Protocols 5, 516-535, (2010); Tang, F. et al. mRNA-Seq whole-transcriptome analysis of a single cell. Nature Methods 6, 377-382, (2009); Ramskold, D. et al. Full-length mRNA-Seq from single-cell levels of RNA and individual circulating tumor cells. Nature Biotechnology 30, 777-782, (2012); and Hashimshony, T., Wagner, F., Sher, N. & Yanai, I. CEL-Seq:Single-Cell RNA-Seq by Multiplexed Linear Amplification. Cell Reports, Volume 2, Issue 3, p 666-673, 2012).

In certain embodiments, the invention involves plate based single cell RNA sequencing (see, e.g., Picelli, S. et al., 2014, "Full-length RNA-seq from single cells using Smart-seq2" Nature protocols 9, 171-181, doi: 10.1038/nprot.2014.006).

In certain embodiments, the invention involves high-throughput single-cell RNA-seq and/or targeted nucleic acid profiling (for example, sequencing, quantitative reverse transcription polymerase chain reaction, and the like) where the RNAs from different cells are tagged individually, allowing a single library to be created while retaining the cell identity of each read. In this regard reference is made to Macosko et al., 2015, "Highly Parallel Genome-wide Expression Profiling of Individual Cells Using Nanoliter Droplets" Cell 161, 1202-1214; International patent application number PCT/US2015/049178, published as WO2016/040476 on Mar. 17, 2016; Klein et al., 2015, "Droplet Barcoding for Single-Cell Transcriptomics Applied to Embryonic Stem Cells" Cell 161, 1187-1201; International patent application number PCT/US2016/027734, published as WO2016168584A1 on Oct. 20, 2016; Zheng, et al., 2016, "Haplotyping germline and cancer genomes with high-throughput linked-read sequencing" Nature Biotechnology 34, 303-311; Zheng, et al., 2017, "Massively parallel digital transcriptional profiling of single cells" Nat. Commun. 8, 14049 doi: 10.1038/ncomms14049; International patent publication number WO2014210353A2; Zilionis, et al., 2017, "Single-cell barcoding and sequencing using droplet microfluidics" Nat Protoc. January; 12(1):44-73; Cao et al., 2017, "Comprehensive single cell transcriptional profiling of a multicellular organism by combinatorial indexing" bioRxiv preprint first posted online Feb. 2, 2017, doi: dx.doi.org/10.1101/104844; Rosenberg et al., 2017, "Scaling single cell transcriptomics through split pool barcoding" bioRxiv preprint first posted online Feb. 2, 2017, doi: dx.doi.org/10.1101/105163; Vitak, et al., "Sequencing thousands of single-cell genomes with combinatorial indexing" Nature Methods, 14(3):302-308, 2017; Cao, et al., Comprehensive single-cell transcriptional profiling of a multicellular organism. Science, 357(6352):661-667, 2017; and Gierahn et al., "Seq-Well: portable, low-cost RNA sequencing of single cells at high throughput" Nature Methods 14, 395-398 (2017), all the contents and disclosure of each of which are herein incorporated by reference in their entirety.

In certain embodiments, the invention involves single nucleus RNA sequencing. In this regard reference is made to Swiech et al., 2014, "In vivo interrogation of gene function in the mammalian brain using CRISPR-Cas9" Nature Biotechnology Vol. 33, pp. 102-106; Habib et al., 2016, "Div-Seq: Single-nucleus RNA-Seq reveals dynamics of rare adult newborn neurons" Science, Vol. 353, Issue 6302, pp. 925-928; Habib et al., 2017, "Massively parallel single-nucleus RNA-seq with DroNc-seq" Nat Methods. 2017 October; 14(10):955-958; and International patent application number PCT/US2016/059239, published as WO2017164936 on Sep. 28, 2017, which are herein incorporated by reference in their entirety.

Any method of HLA typing known in the art may be used for the present invention (see, e.g., Erlich, HLA typing using next generation sequencing: An overview, Human Immunology 76 (2015) 887-890).

A second portion from the same sample may be used for T-cell profiling. In certain embodiments, the invention involves identifying T cell receptors (TCR) specific for activation by an immunodominant epitope of the present invention. Identifying, cloning and expressing TCRs according to the present invention may be performed according to any methods known in the art. CD4+ T cells may be isolated by sorting for CD4+ cells. Regarding TCR sequencing, single cell TCR sequencing and expression of TCRs on an immune cell, reference is made to International patent application, "Methods of isolating T cell receptors," serial number PCT/US2015/067154 and published as WO2016100977A1; Rosati et al., Overview of methodologies for T-cell receptor repertoire analysis BMC Biotechnol. 2017, 17:61; and Calis and Rosenberg, Characterizing immune repertoires by high throughput sequencing: strategies and applications Trends Immunol. 35(12): 581-590, incorporated herein in its entirety. T cells may be profiled, for example using single cell RNA-seq to differentiate between T cells of a pathogenic and protective phenotype. The sample may be further analyzed using single cell TCR-seq to identify pathogenic TCRs and protective TCRs. Single cell RNA-seq targeted for TCRs (TCRseq) is described further in materials and methods.

Epitopes identified using the methods disclosed herein may be cloned into a first peptide library, such as a lentiviral peptide MHCII$\zeta\zeta$ library using known methods in the art. Likewise, the identified TCRs may be cloned into a second library, such as a lentiviral TCR$\zeta\zeta$ library. The first and second libraries may then be transfected into appropriate cell types to allow expression of the peptide-MHCII and TCR complexes on localization on the cell membrane respectively. For example, the peptide-MHCII library may be clone into a BW5147 cell line, and the TCR library may be cloned into a BW5147-CD4.2 cell line. One cell line may further be modified to include a reporter system that generates a detectable signal upon binding of the TCR and peptide-MHC complexes. For example, the cell line comprising the MHCII library may further include a reporter construct. In certain example embodiments, the reporter construct may comprise a GFP under control of an inducible promoter. The inducible promoter may be under the control of or responsive to a signal generated by an activated TCR or MHCII complex. For example, the reporter construct may the inducible promoter may activate expression of GFP in response to IL-2 production. While GFP is provided by way of example, other detectable signals that facilitate sorting and/or isolation of the peptide-MHCII expressing cells may also be used. The TCR expressing and peptide-MHCII expressing cells are brought into contact with one another under conditions to allow binding between complementary TCR and MHCII complexes. Activated MHCII expressing cells are then sort or otherwise isolated based on expression of the detectable signal. The MHC peptides are subsequently isolated and sequenced using known methods in the art. The number of peptide sequencing reads per peptide provides a measure of each epitopes immunodominance. The present invention may use any known method of peptide sequencing known in the art (see, e.g., U.S. Pat. No. 6,379,970).

In certain example embodiments, peptides with the requisite or desired degree of immunodominance are then isolated and further used to prepare immunogenic compositions as described above. Said peptides may also be used for Ag-specific expansion of endogenous T-cells and/or Ag-specific depletion of endogenous T cells using known methods in the art.

Probing the Host-Commensal Relationship to Reveal "Health Status" of the Immune System The human microbiota is the aggregate of microorganisms that resides on or within any of a number of human tissues and biofluids, including the skin, mammary glands, placenta, seminal fluid, uterus, ovarian follicles, lung, saliva, oral mucosa, conjunctiva, biliary and gastrointestinal tracts. They include bacteria, archaea, fungi, protists and viruses. Some microorganisms that colonize humans are commensal, meaning they co-exist without harming humans.

Figure 20:
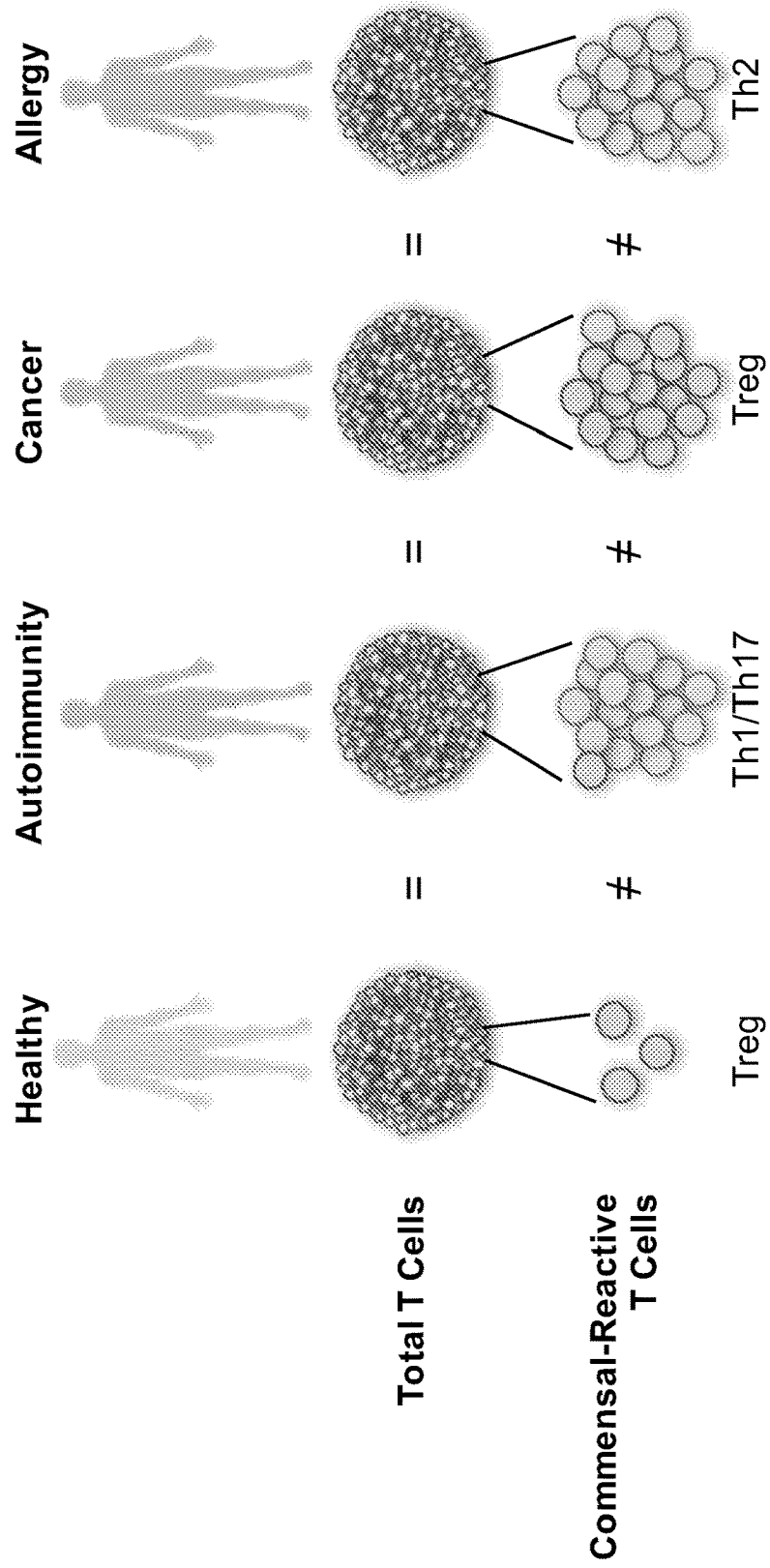
FIG. 20—Illustrates immune cell type reactivity and health status.
Figure 21:
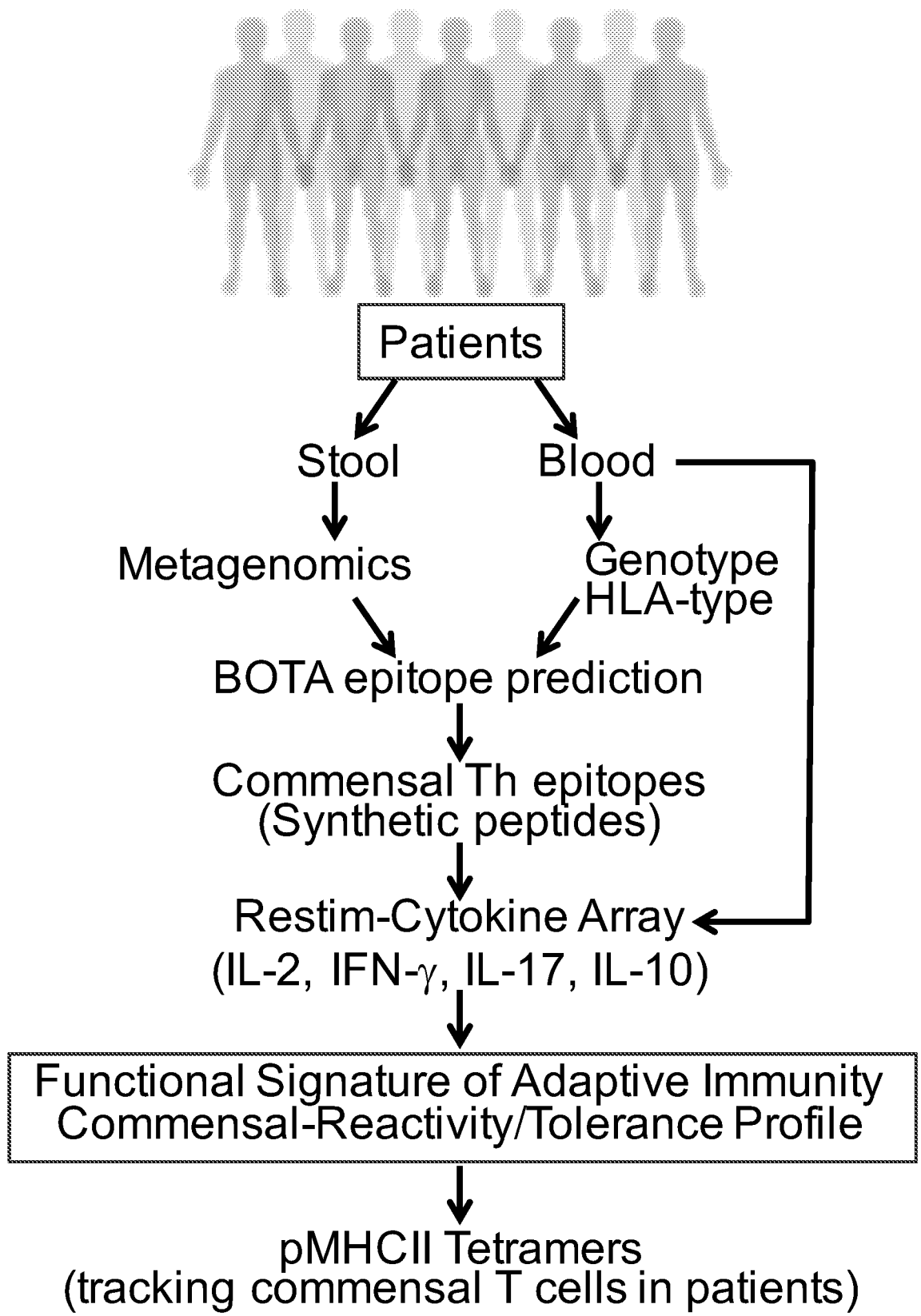
FIG. 21—Illustrates a clinical immunology pipeline for identifying HLA specific epitopes for use in measuring commensal-reactivity/tolerance profiles and for tracking commensal T cells in patients using the epitopes.

In certain embodiments, monitoring the magnitude and nature of the T cell response to specific commensal antigens can reveal the health status of the immune system. For example, having Tregs reactive to commensal epitopes may indicate health, having Th1/Th17 cells reactive to commensal epitopes may indicate autoimmunity, having Tregs reactive to tumor antigen epitopes may indicate cancer status (e.g., a suppressed immune response to the tumor), and having Th2 cells reactive to allergen epitopes may indicate allergy (see, FIG. 20). In certain embodiments, pMHCII tetramers are used to track commensal T cells in a subject (see, FIG. 21).

In the state of health, the adaptive immune system maintains tolerance to local gut antigen exposure and protection from systemic infection. The sheer number of bacterial species and diversity of protein-coding elements in the microbiome represents an enormous search space. Towards identifying immunogenic commensals, Applicants developed "serum immunoglobulin commensal capture and sequencing" (SICC-seq). In certain embodiments, commensal epitopes are predicted from sequencing data obtained from a biological sample. For example, a sample may be taken from a subject (e.g., stool) and the microbiota may be identified. Genomes of organisms in the microbiota may be identified and MHCII epitopes predicted according to the present invention (e.g., according to HLA-type of the subject). In certain embodiments, the HLA type of the subject is determined using a blood sample (e.g., serum). In certain embodiments, the epitopes are used to detect cytokine production in immune cells (e.g., T cells) obtained from the subject (e.g., IL-2, IFN-γ, IL-17, IL-10) (see, FIG. 21). Cytokine assays (e.g., cytokine arrays) are well known in the art. In certain embodiments, IL-10 secretion in response to an epitope indicates health (e.g., secretion from Tregs). In certain embodiments, secretion of IL-17 (e.g., Th17 cells) indicates autoimmunity. In certain embodiments, pMHCII tetramers are used to track commensal T cells secreting the cytokines in the subject (see, FIG. 21).

The present invention has advantageously used MHCII peptidomics to identify novel bacterial antigens. Additionally, Applicants have determined novel features of antigenicity from immunopeptidome generally applicable to the prediction of any MHCII binding peptide. Moreover, Applicants have advantageously provided a deep neural network algorithm, BOTA, that predicts immunodominant epitopes. Finally, Applicants have determined that host autophagy pathways differentially control epitope selection.

Although specific embodiments have been described above in detail, the description is merely for purposes of illustration. It should be appreciated, therefore, that many aspects described above are not intended as required or essential elements unless explicitly stated otherwise. Modifications of, and equivalent components or acts corresponding to, the disclosed aspects of the example embodiments, in addition to those described above, can be made by a person of ordinary skill in the art, having the benefit of the present disclosure, without departing from the spirit and scope of embodiments defined in the following claims, the scope of which is to be accorded the broadest interpretation so as to encompass such modifications and equivalent structures.

This invention is further illustrated by the following examples, which are not to be construed in any way as imposing limitations upon the scope thereof. On the contrary, it is to be clearly understood that resort may be had to various other embodiments, modifications, and equivalents thereof which, after reading the description herein, may suggest themselves to those skilled in the art without departing from the spirit of the present invention and/or the scope of the appended claims.

EXAMPLES

Example 1—MHCII Peptidomics in Primary Murine Dendritic Cells Defines Biochemical Features of Antigenicity Defining the immunodominance hierarchy of T cell epitopes remains a significant challenge in the context of infectious disease, autoimmunity, and immune oncology. Even for some of the most widespread bacterial pathogens, little is known about which antigens drive protective CD4 T cell responses. Towards the aim of defining features of antigenicity, Applicants developed a proteomics-based approach to identify MHCII-associated peptides in murine bone marrow-derived dendritic cells (BMDCs) from C57BL/6J mice expressing I-A$^b$. In these experiments, mature peptide-MHCII complexes were immunoprecipitated from primary BMDCs with monoclonal Y3P antibody (Janeway et al., 1984). Associated peptides from biological replicates were acid-eluted, chemically labeled with iTRAQ isobaric mass tags for relative quantification, mixed, and analyzed using high resolution, accurate mass liquid chromatography-tandem mass spectrometry (LC-MS/MS) (FIG. 7A). This approach identified 3,671 unique peptides derived from 1,088 autologous murine proteins (FIG. 7B and SEQ ID NOs: 1-14979). The sensitivity afforded by Orbitrap detection methods in combination with differential mass tagging by iTRAQ enabled relative quantitation of significantly more peptides than previously reported approaches.

Having generated an expansive catalogue of the MHCII immunopeptidome in murine BMDCs, Applicants sought to identify key biochemical features of antigenicity. Initially, Applicants derived the optimal I-A$^b$-binding motif from primary sequence features in autologous murine peptides (FIG. 7C). The resulting 9mer core peptide sequence resembles previous predictions based on in vitro binding kinetics between synthetic peptide libraries and purified I-A$^b$ (Andreatta et al., 2011). In contrast, Applicants detected a strong preference for proline in the P4 position.

Example 2—Autophagy Shapes the MHCII Immunopeptidome

Figure 8A:
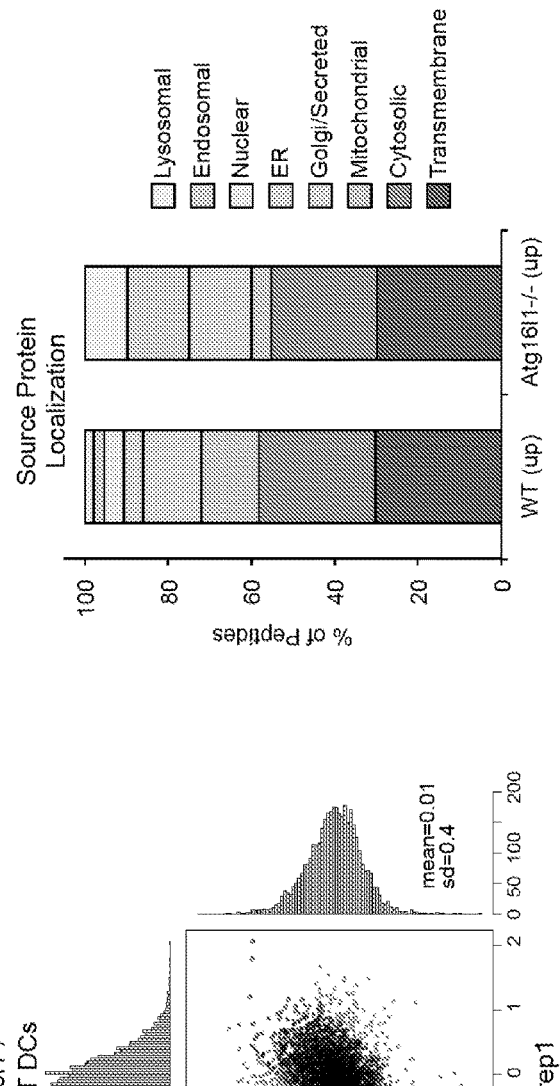
FIG. 8A shows that deficiency in the autophagy protein Atg16l1 dramatically skews the spectrum of MHCII-associated peptides. MHCII-bound peptides quantified in Atg6l1$^{-/-}$ dendritic cells relative to wild type (WT). Replicate (rep) samples were compared based on log 2 fold change (FC) between mouse strains. Each dot represents a unique peptide sequence. Peptides that were observed to be significantly upregulated or downregulated are shown, while peptide measurements that were not reproducible across both biological replicates are also shown. Dot plot axes: Log 2 FC. Histogram axes: number of distinct peptides.
Figure 8B:
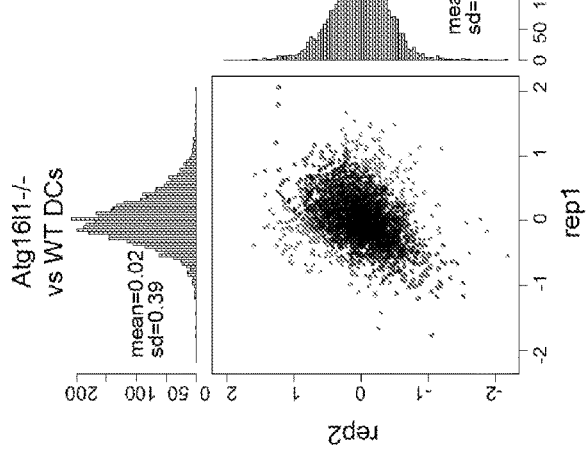
FIG. 8B shows the abundance and subcellular sources of MHCII-associated peptides derived from Atg16l1$^{-/-}$ and WT dendritic cells.
Figure 8C:
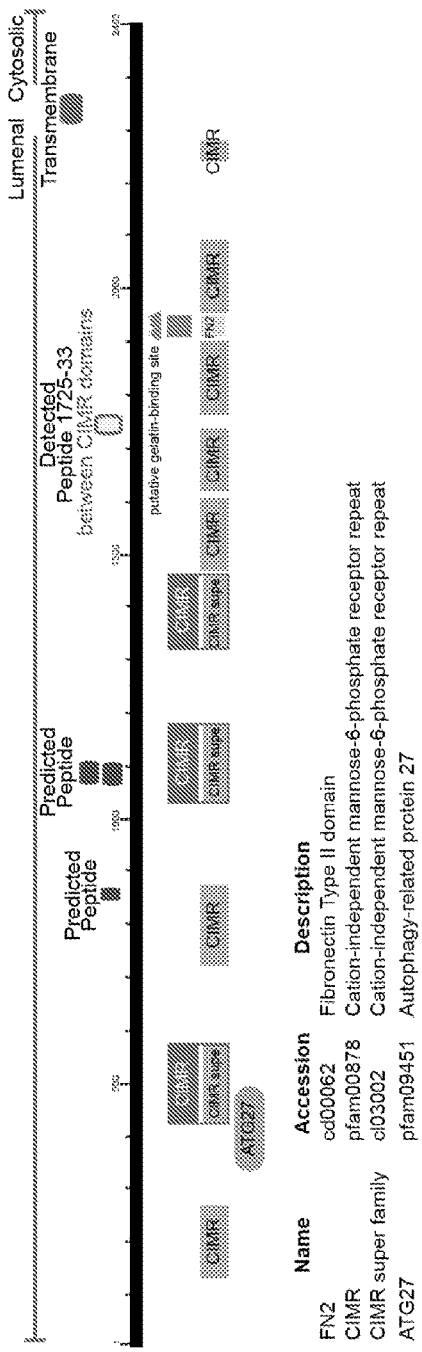
FIG. 8C shows epitope mapping relative to domain structure of endogenous antigens indicates preferential presentation of epitopes derived from the lumenal/extracellular domains of transmembrane proteins and epitopes positioned between structurally-defined domains.

The primary sequence of antigenic peptides confers binding to MHCII but does not represent the only factor governing antigenicity. The nature of how host pathways shape the immunopeptidome remains incompletely understood. Given that lysosomal pathways contribute to antigen processing and epitope selection, Applicants hypothesized that autophagy shapes the immunopeptidome by dictating which antigens gain access to the lysosomal compartment. Applicants aimed to shed light on the subject by leveraging MHCII peptidomics. The core autophagy protein ATG16L1 is required for macroautophagy and xenophagy, which divert cytosolic cargo to lysosomes for disposal. To selectively perturb autophagy in antigen-presenting cells, Applicants generated Atg16l1$^{f/f}$×CD11c-Cre mice (Atg16l1$^{-/-}$). MHCII peptidomics experiments demonstrated that Atg16l1$^{-/-}$BMDCs were severely impaired in their ability to present peptides derived from organelle-derived and cytosolic proteins (FIGS. 8A and 8B). In contrast, Atg16l1$^{-/-}$ cells displayed elevated levels of lysosome- and endosome-derived peptides compared to WT BMDCs (FIGS. 8B and 8E). These findings are consistent with the known role for Atg16l1 in macroautophagy and highlight the degree to which lysosomal trafficking impacts the spectrum of peptides presented by MHCII.

Figure 16:
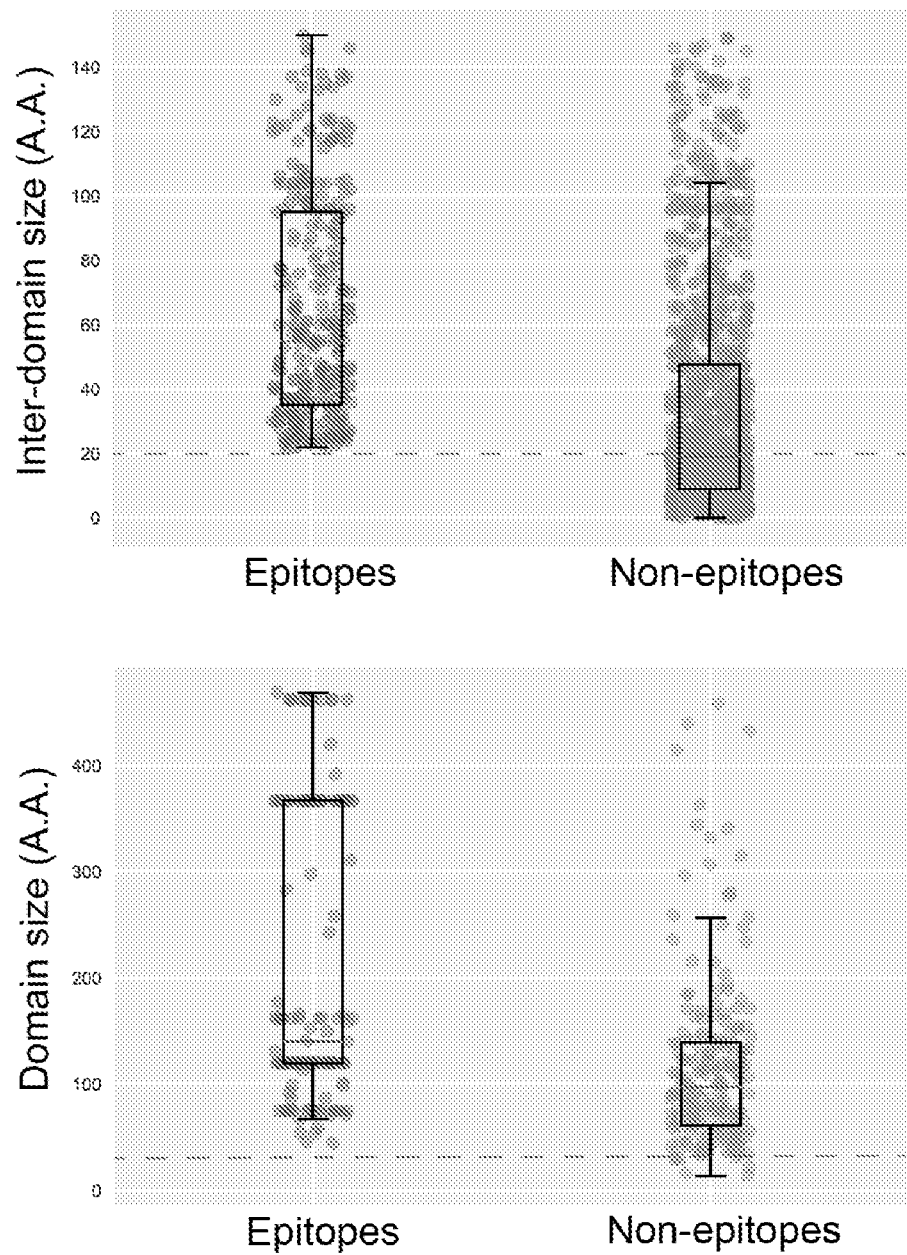
FIG. 16—Features of antigenicity. Epitopes from MHCII peptidomics experiments were mapped back to the endogenous murine proteins from which they derived. If epitopes localized between PFAM domains, inter-domain sizes were plotted (Top). For epitopes that localized within PFAM domains, the domain sizes were plotted (Bottom). The same procedure was performed for Non-epitopes, which were defined as peptides conforming to the I-A$^b$-binding consensus motif (motif score $>5 \times 10^{-11}$). Epitopes preferentially derived from inter-domain regions that are greater than 20 amino acids in length or from within domains of more than 30 amino acids. A.A.; amino acids.

Given the abundance of MHCII-associated peptides derived from endolysosomal proteins, Applicants queried these sequences to define additional features of antigenicity. Using the high-resolution I-A$^b$-binding motif as a reference sequence (FIG. 7C), Applicants scanned endolysosomal proteins identified by proteomics for consensus. As expected, Applicants were able to retrospectively predict peptides that were identified by mass spectrometry; however, Applicants found many instances of consensus sites that were not presented on MHCII. In the vast majority of these cases, consensus sites located within structured protein domains were not detected by proteomics, whereas those located in unstructured inter-domain regions were. For example, MHCII peptidomics identified one peptide derived from the murine cation-independent mannose 6-phosphate receptor (CI-MPR). This peptide is located between two CIMR domains. In contrast, Applicants found three additional peptides conforming to the I-A$^b$-binding consensus motif that were located within CIMR domains and were not detected as processed peptides bound to MHCII (FIG. 8C). Across the entire dataset, epitopes preferentially derived from interdomain regions of greater than 20 amino acids or protein domains greater than 30 amino acids (FIGS. 13 and 16). Thus, epitope accessibility in the context of native proteins is an important factor that impacts MHCII binding and protease processing.

Example 3—Training a Deep Neural Network on MHCII Peptidomics Data

Having demonstrated that MHCII peptidomics can identify antigenic features conferred by lysosomal processing, Applicants leveraged this dataset to devise a neural network-based algorithm for epitope prediction. Historically, predicting MHCII binding strength for a given peptide has been challenging. The concept of epitope accessibility, together with MHCII affinity, adds to the complexity of formulating predictions for immunodominant epitopes. Such features are not adequately captured by linear relationships; rather, a non-linear architecture is more appropriate. Therefore, Applicants explored the use of a deep neural network-based algorithm to predict these epitopes using peptidomics data as a training set.

Figure 8D:
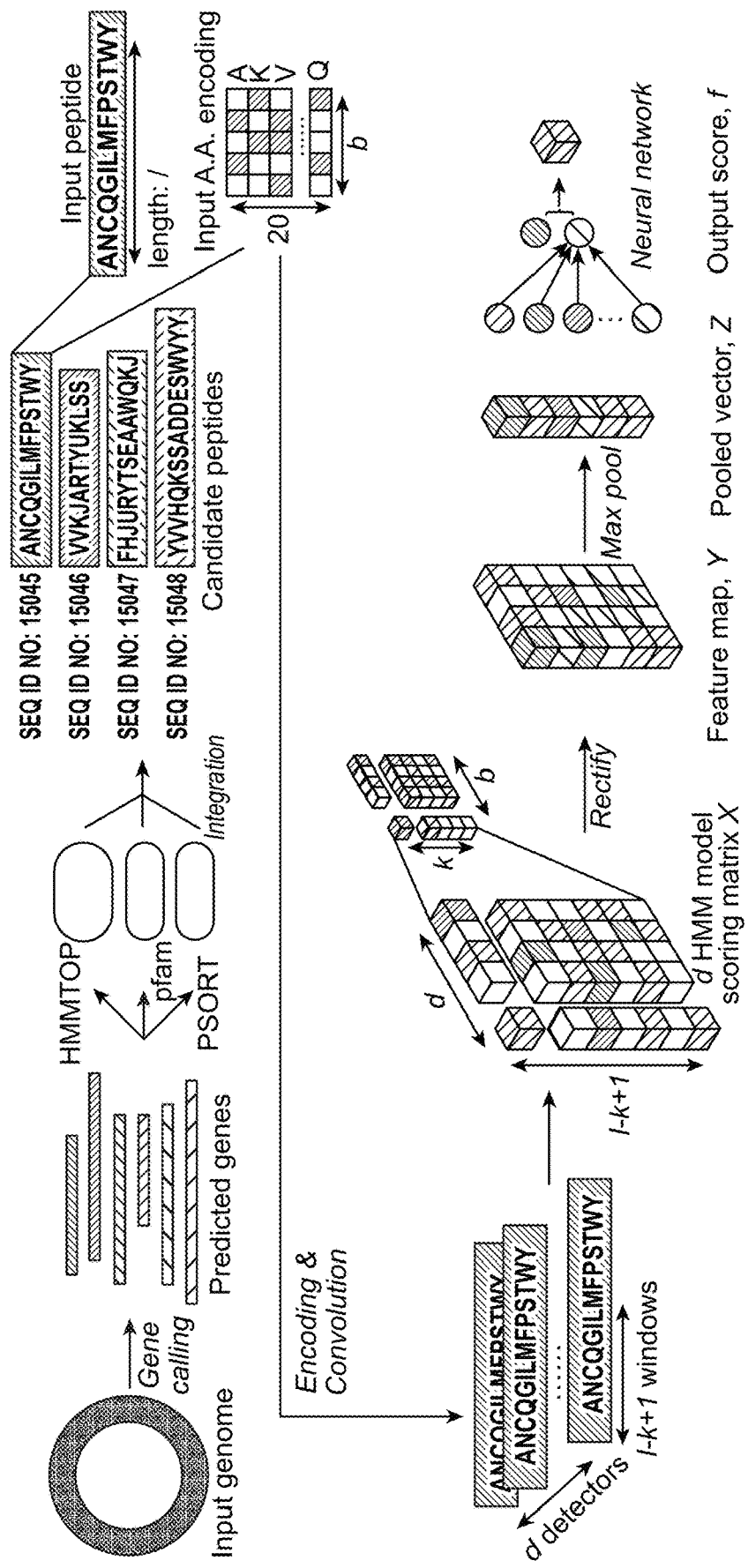
FIG. 8D shows immunodominant epitope prediction with BOTA. Workflow of BOTA with input as genome and output as a binding score. The upper panel shows the extraction of candidate peptides (SEQ ID NOs: 15045-15048), and the lower panel shows the deep neural network core of the BOTA algorithm to assign a binding score to each candidate peptide.
Figure 8E:
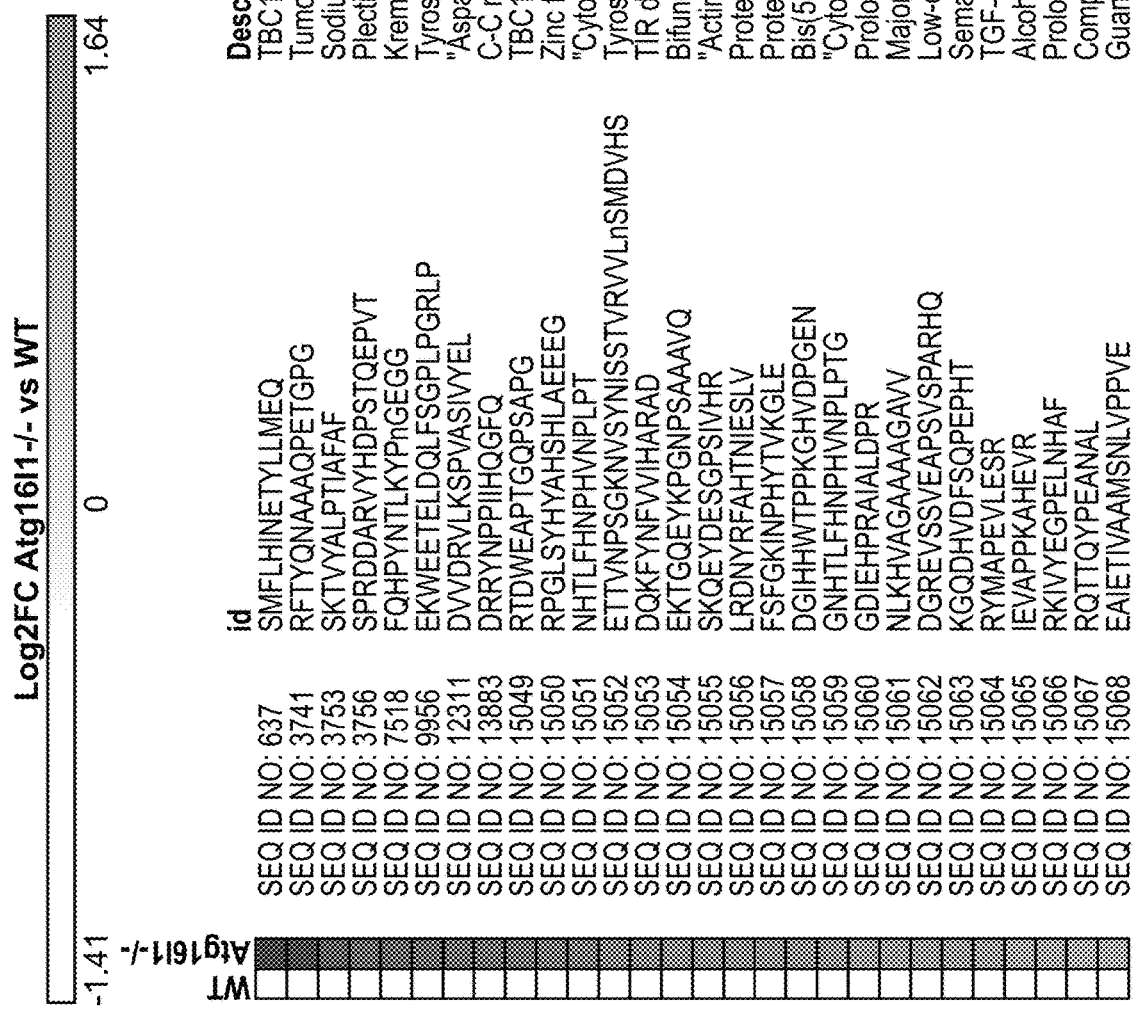
FIG. 8E shows MHCII-associated peptides derived from Atg16l1$^{-/-}$ and WT dendritic cells. Shown are SEQ ID NOs: 637, 3741, 3753, 3756, 7518, 9956, 12311, 13883, and 15049-15100, respectively.

Applicants developed a model, bacteria-origin T cell antigen (BOTA) predictor, that generates a list of candidate peptides utilizing information including protein cellular location, transmembrane structure (if applicable), and domain distribution (FIG. 8D). BOTA requires only an annotated genome input to extract amino acid sequences of protein-coding genes. BOTA then relies on outputs from three algorithms: HMMTOP, PSORT, and HMMER's search against pfam. First, BOTA identifies secreted and cell wall proteins (Yu et al., 2010). Second, it masks intracellular regions and transmembrane domains of cell wall proteins (with an 8-amino acid flanking buffer) (Tusnady and Simon, 1998). Third, it excludes regions that fall within small domains or between a series of adjacent domains (inaccessible, compact folding) (Marchler-Bauer et al., 2015). The metric used for domain mapping includes the distance to the up/downstream domains, the density of flanking domains, and the domain size. Finally, candidate protein regions are piped into the deep neural network predictor to generate their probabilities to be MHCII binders (FIG. 8D). Applicants note that this pipeline is modular and can be used to generate allele-specific models in both human and model animals.

The core algorithm of BOTA is a deep neural network, which employs a sparse representation of input peptides and multiple pre-trained binder models to generate a feature map. The feature map includes many nonlinear summarizations of peptide features that are used to make predictions. The output from the deep neural network is a score (f) that serves as an indicator of MHCII binding. In the case of mouse I-A$^b$, Applicants used proteomics data to train the BOTA model. The model was trained using randomly sampled parameters 30 times on a 3-fold cross-validation scheme. The optimal parameter calibration was selected based on their receiver operating characteristic curves (ROC AUCs).

The advantages of BOTA in comparison to current methods are that BOTA (1) requires only whole genome, not polypeptides, as input, (2) considers epitope accessibility by focusing the search on extracellular regions of proteins and epitope location relative to protein domain organization, (3) is trained on peptidomics data from antigen-presenting cells, which are significantly more accurate than in vitro peptide binding data, and (4) easily scales to thousands of genomes for different alleles. Thus, BOTA is capable of accurately predicting immunogenic epitopes from medically relevant bacterial pathogens.

Figure 9B:
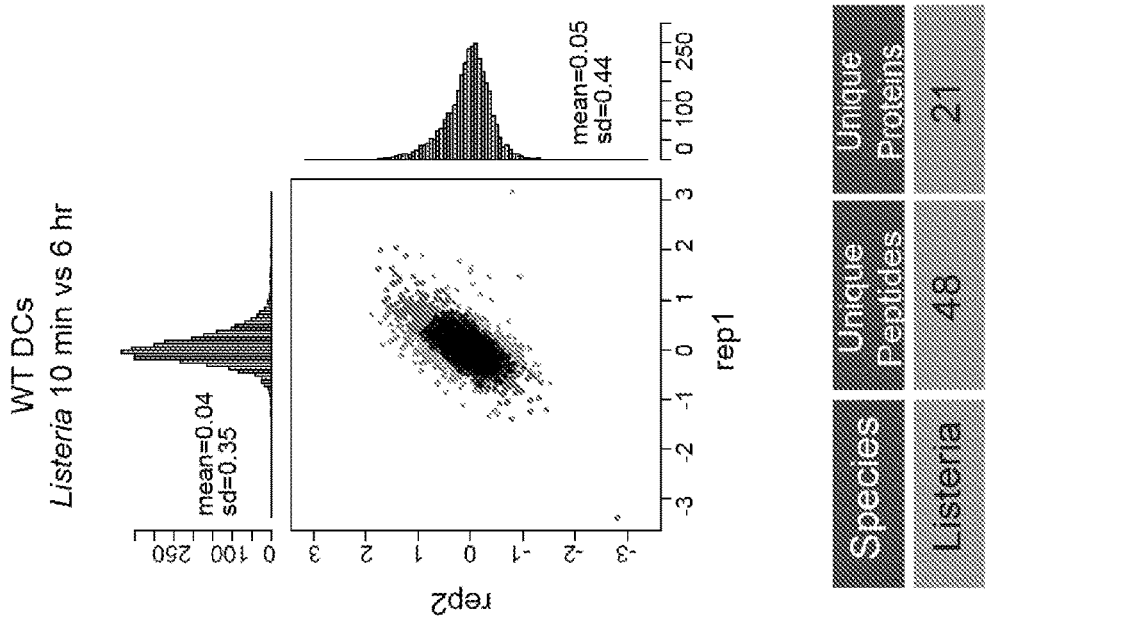
FIG. 9B shows MHCII-bound peptides detected before and after Listeria exposure. Biological replicates (rep) were compared based on log 2 fold change (FC) between time 10 min and 6 hr after exposure to bacteria. Each dot represents a unique peptide sequence. Peptides that were observed to be significantly upregulated or downregulated are shown, while peptide measurements that were not reproducible across both biological replicates are also shown. Dot plot axes: Log 2FC. Histogram axes: number of distinct peptides.
Figure 9A:
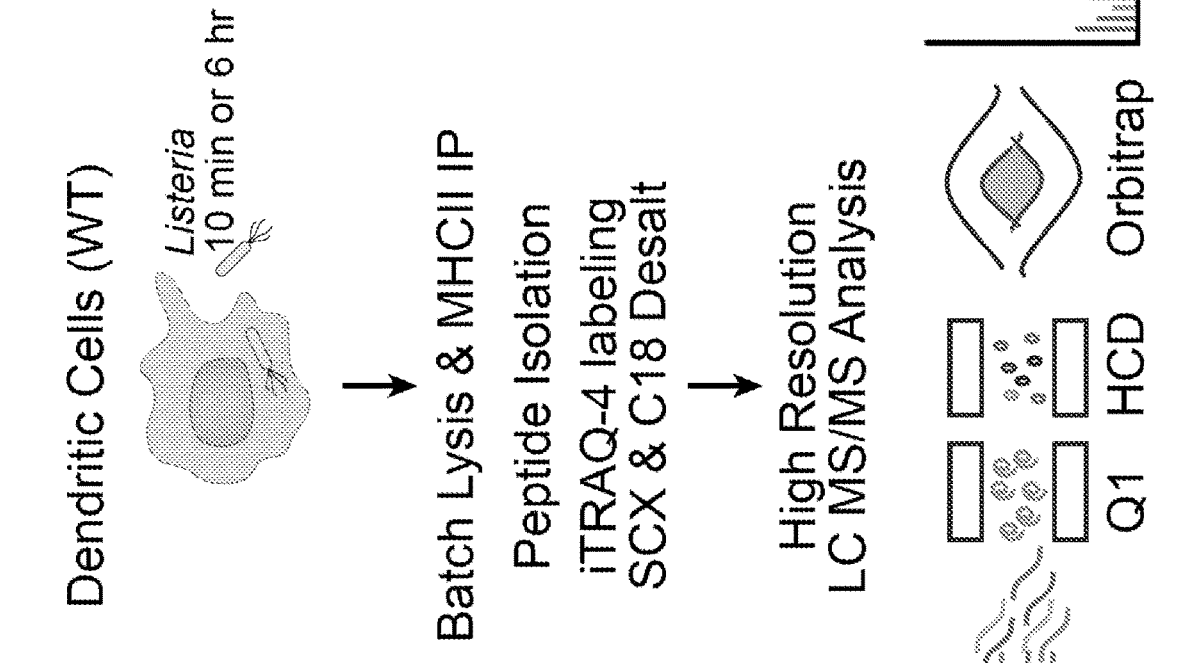
FIG. 9A shows an experimental workflow for immunopurification and sequencing of MHCII-associated peptides from murine dendritic cells. MHCII-peptide complexes were immunopurified from WT cells after a 10-minute or 6-hour Listeria treatment. Associated peptides were then acid-eluted, labeled with iTRAQ4 reagents, desalted with SCX and C18, and analyzed using high resolution LC-MS/MS.

Example 4—Validation of BOTA Epitope Predictions for *Listeria* with MHCII Peptidomics To validate BOTA, Applicants tested its performance in predicting MHCII-restricted epitopes from *Listeria monocytogenes*, one of the most common foodborne pathogens associated with a relatively high mortality rate (Scallan et al., 2011). Despite the epidemiological impact of listeriosis, the number of experimentally validated CD4 T cell epitopes encoded within the *Listeria* genome is limited. Thus, Applicants first sought to identify MHCII-associated peptides in BMDCs exposed to live *Listeria* by peptidomics. In these experiments, primary BMDCs were exposed to live *L. monocytogenes* for 10 minutes or 6 hours prior to immunoprecipitation of mature peptide-MHCII complexes with monoclonal Y3P antibody (Janeway et al., 1984). Associated peptides from biological replicates of the 10-minute and 6-hour timepoints were analyzed using mass spectrometry (LC-MS/MS) (FIGS. 9A and B). These experiments discovered 48 unique peptides derived from exogenous *Listeria* proteins. Twenty-nine of these peptides represented nested sets derived from 7 unique proteins (Table 1). The second-most enriched peptide was the previously identified immunodominant epitope from listeriolysin O ($LLO_{190-205}$), while the remaining peptides represented novel candidate antigens. Notably, all of the detected peptides were derived from secreted proteins or cell wall proteins. These observations highlight the importance of epitope accessibility for antigen presentation. Together, this dataset represents the first example of identifying processed peptide antigens derived from a live bacterial pathogen.

Figure 9C:
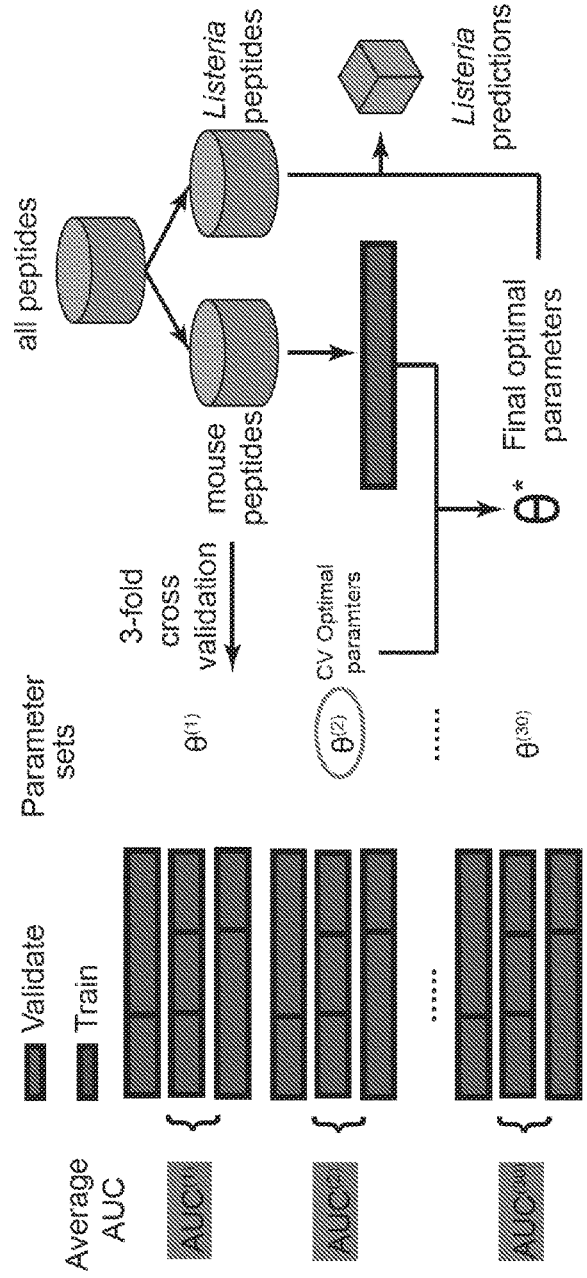
FIG. 9C shows predictions for Listeria epitopes were made using the deep neural network core of BOTA.
Figure 9E:
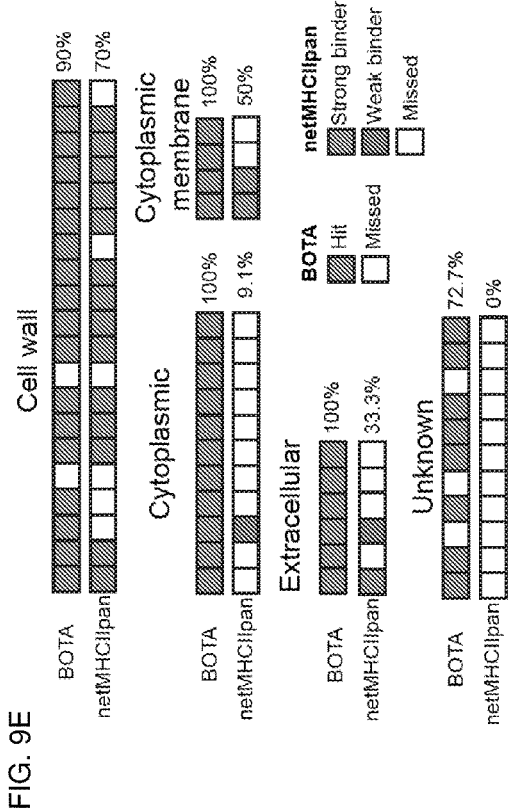
FIG. 9E shows a comparison of predictions for Listeria epitopes in proteins identified by proteomics. Peptides are split into categories based on the protein's subcellular localization using PSORTb.
Figure 9D:
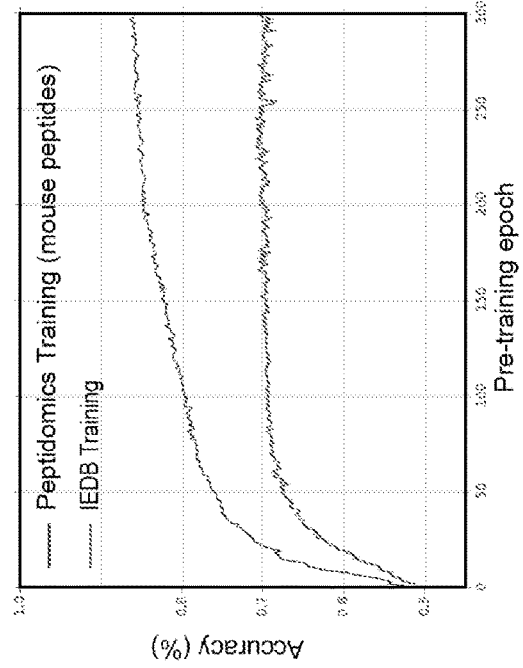
FIG. 9D shows that the BOTA model pre-training accuracy plateaus after 200 epochs in cross-validation. The model was trained using the mouse peptides captured in BMDCs infected by Listeria (line); in contrast, the same model trained solely on Immune Epitope Database (IEDB) data reached a plateau at approximately 70%, signifying a 15% gap in accuracy.

Applicants next compared *Listeria* peptides identified by MHCII peptidomics with BOTA predictions. Nine out of 17 BOTA-predicted epitopes were validated by MHCII peptidomics (Table 2). Of the 35 unique *Listeria* peptides identified by proteomics with an adjusted p value<0.05, BOTA-predicted epitopes were present in 28. Applicants compared the prediction accuracy of the BOTA model between training with two data sets: peptides captured in murine dendritic cells ("Peptidomics Training") and MHCII-associated peptides from the Immune Epitope Database ("IEDB Training") (FIG. 9D). Both BOTA pre-training accuracies plateaued after 200 epochs, but BOTA training with the peptidomics data increased prediction accuracy over training with IEDB data by 15%. Notably, BOTA showed strong improvement over the current prediction methods, including the state-of-the-art netMHCIIpan (Andreatta et al., 2011) (FIG. 9E). Thus, BOTA performs well in predicting dominant CD4 T cell epitopes (Table 2).

Improvement in prediction accuracy by BOTA also signifies the successful application of a deep neural network to a complex biomedical problem. Previous efforts using traditional neural networks or hidden Markov models were limited by their ability to extract highly abstract features, thus leading to insufficient insights into epitope prediction (Wang et al., 2008). The important innovation of BOTA is its utility in predicting CD4 T cell epitopes for virtually any MHCII allele and any antigen source, including commensal microbes, pathogens, autoantigens, and tumor antigens.

Figure 10D:
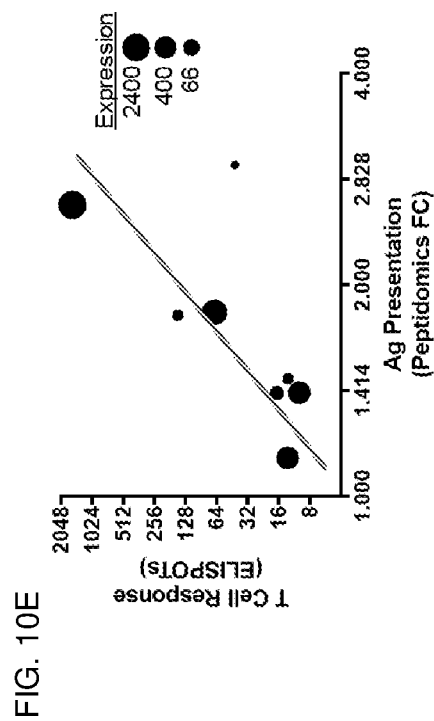
FIG. 10—BOTA and MHCII peptidomics accurately predict immunodominance in vivo.
FIG. 10A shows epitope mapping and domain structure of Listeria antigens indicate preferential presentation of surface-exposed and secreted proteins.
FIG. 10B shows that immunodominance of epitopes was determined by infecting mice with Listeria. At day 7, splenocytes were harvested and restimulated with the indicated peptides for quantification of the T cell response by IFNγ ELISPOT. Data represent the mean number of spots per $1\times10^5$ CD4 T cells±sd for n=6 mice.
Figure 10E:
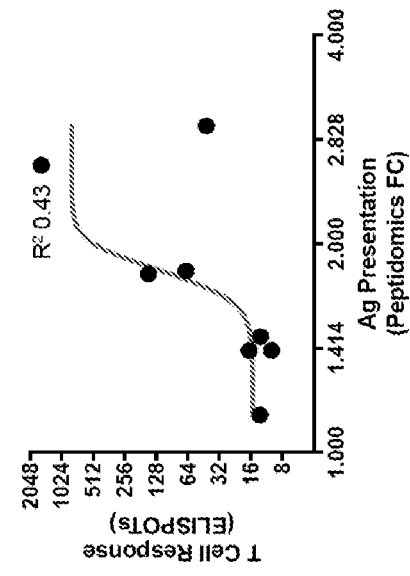
Figure 10B:
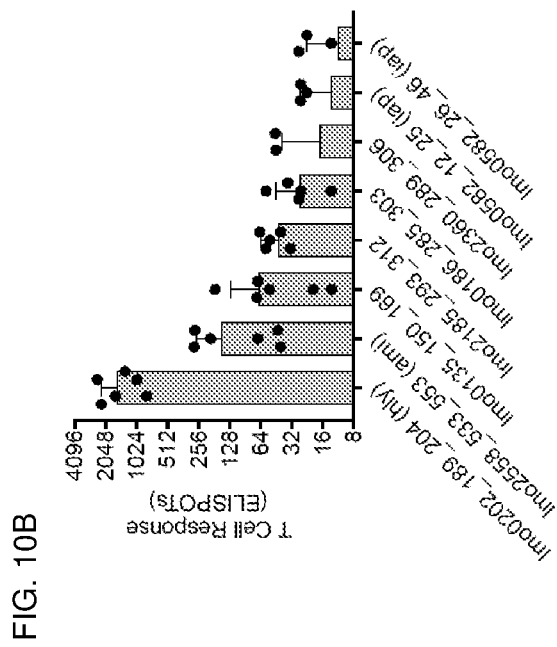
Figure 10C:
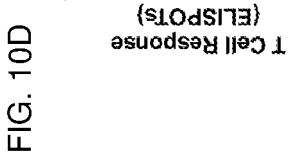

Example 5-BOTA and MHCII Peptidomics Predict Immunodominance of *Listeria* Epitopes In Vivo Given that MHCII peptidomics and BOTA successfully identified *Listeria* peptides and features associated with efficient antigen presentation, Applicants sought to measure T cell responses to these epitopes in vivo. To quantify the CD4 T cell response directed to the top eight candidate *Listeria* epitopes, mice were sacrificed seven days after intraperitoneal (i.p.) infection with *Listeria*. T cells were restimulated in vitro with synthetic peptides, and IFN-γ responses were enumerated by ELISPOT. Robust responses were detected against four of the eight epitopes (lmo0202, lmo2558, lmo2185, lmo0135) (FIG. 10A). The remaining four epitopes elicited weaker responses near the limit of detection for ELISPOT (FIG. 10B). Notably, the T cell response to these eight candidate epitopes correlated remarkably well with their abundances detected by MHCII peptidomics (FIG. 10C). RNA expression of *Listeria* antigens (Chatterjee et al., 2006) correlated with the corresponding T cell response to a lesser extent (FIG. 10D), although low expression did not appear to preclude antigenicity (FIG. 10E).

Figure 17:
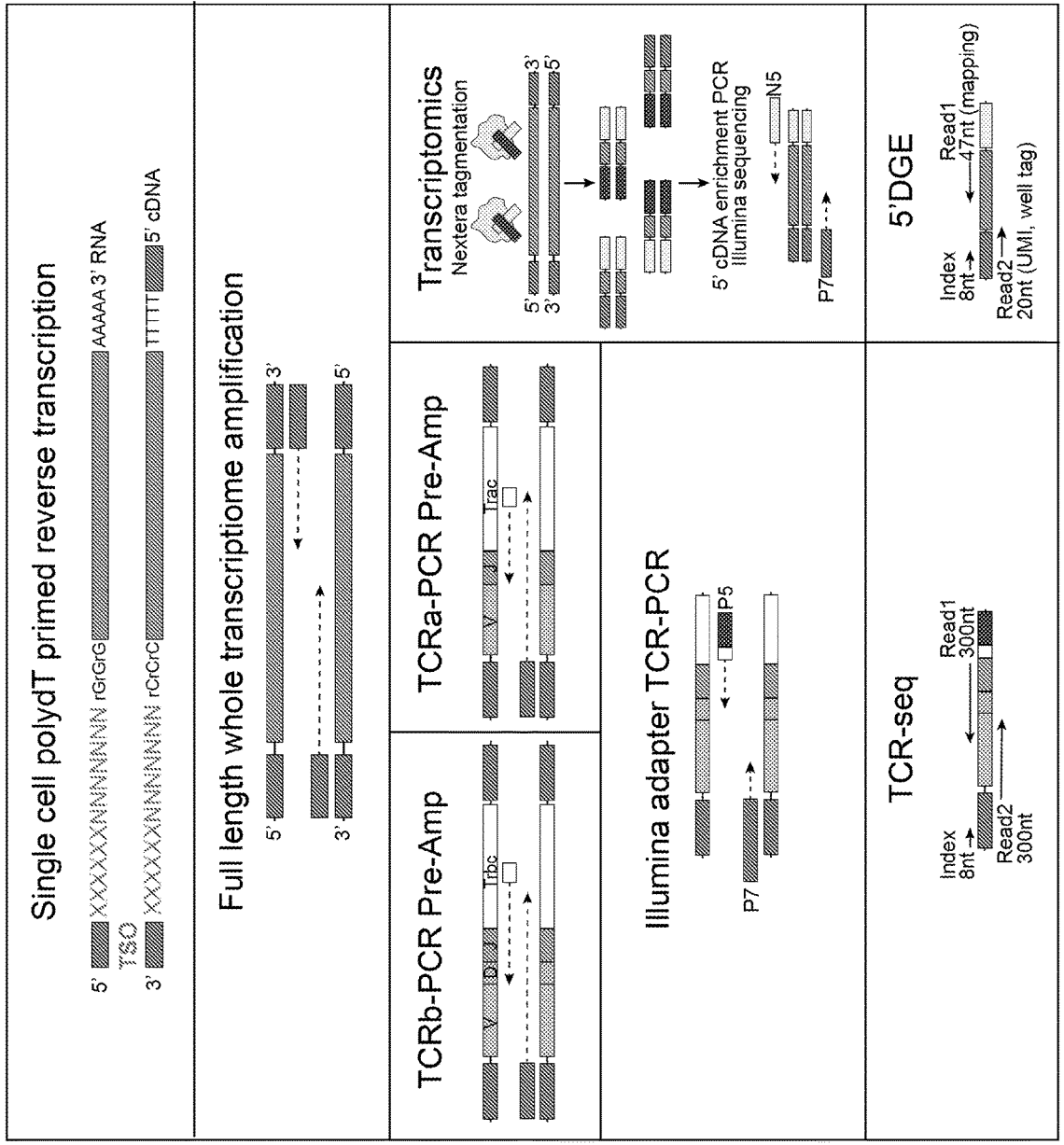
FIG. 17—Strategy for TCRseq coupled with whole transcriptome sequencing. Single T cells are FACS-sorted into individual wells of 384-well PCR plates. First-strand cDNA is primed with polydT oligonucleotide appended with adaptor. Template switching during reverse transcription appends the cDNA with well barcodes (XXXXXX), unique molecular identifiers (NNNNNNN), and adapters. Whole transcriptome amplification (WTA) is then performed with PCR primers complementary to the sequencing adapters. After WTA, individual wells are pooled, DNA is purified, and then divided into three fractions to produce sequencing libraries for TCR-alpha, TCR-beta, and 5' digital gene expression (5'DGE). TCR pre-amplification is performed with PCR primers complementary to 5' adapter and TCR constant domain. A second round TCR PCR is then performed with PCR primers containing full-length P7 Illumina sequencing adapters that are complementary to 5' template DNA and a nested primer complementary to the TCR constant domain and appended with P5 illumina sequencing adapters. TCR libraries were sequenced with a 608 cycle MiSeq run. 5'DGE libraries are produced by tagmentation of pooled WTA reactions. A 5' cDNA enrichment PCR adds full length P7 Illumina sequencing adapters and N5 Nextera sequencing adapters. 5'DGE libraries were sequenced with a 75 cycle NextSeq run.

Example 6—Integration of T Cell Phenotype with TCR Specificity in the *Listeria* Response Having demonstrated the utility of BOTA for predicting bacterial epitopes, Applicants next sought to rigorously characterize the antigen-specific T cell response to *Listeria*. Standard approaches for defining immunodominance, such as ELISPOT, rely on ranking candidate epitopes based on the magnitudes of the T cell responses they elicit in vivo. However, such approaches require prior knowledge of TCR specificity and T cell phenotype (cytokine profile) and cannot account for T cell responses to epitopes that have not been tested, but may be dominant. To address these limitations, Applicants developed a procedure for single cell analysis of T cell phenotypes matched to their corresponding TCR sequences. This TCRseq approach allows for simultaneous enumeration of T cell clonal frequency and cytokine profiles (FIG. 17). Dominant TCR clones can then be screened for reactivity against *Listeria* epitopes.

Figure 11D:
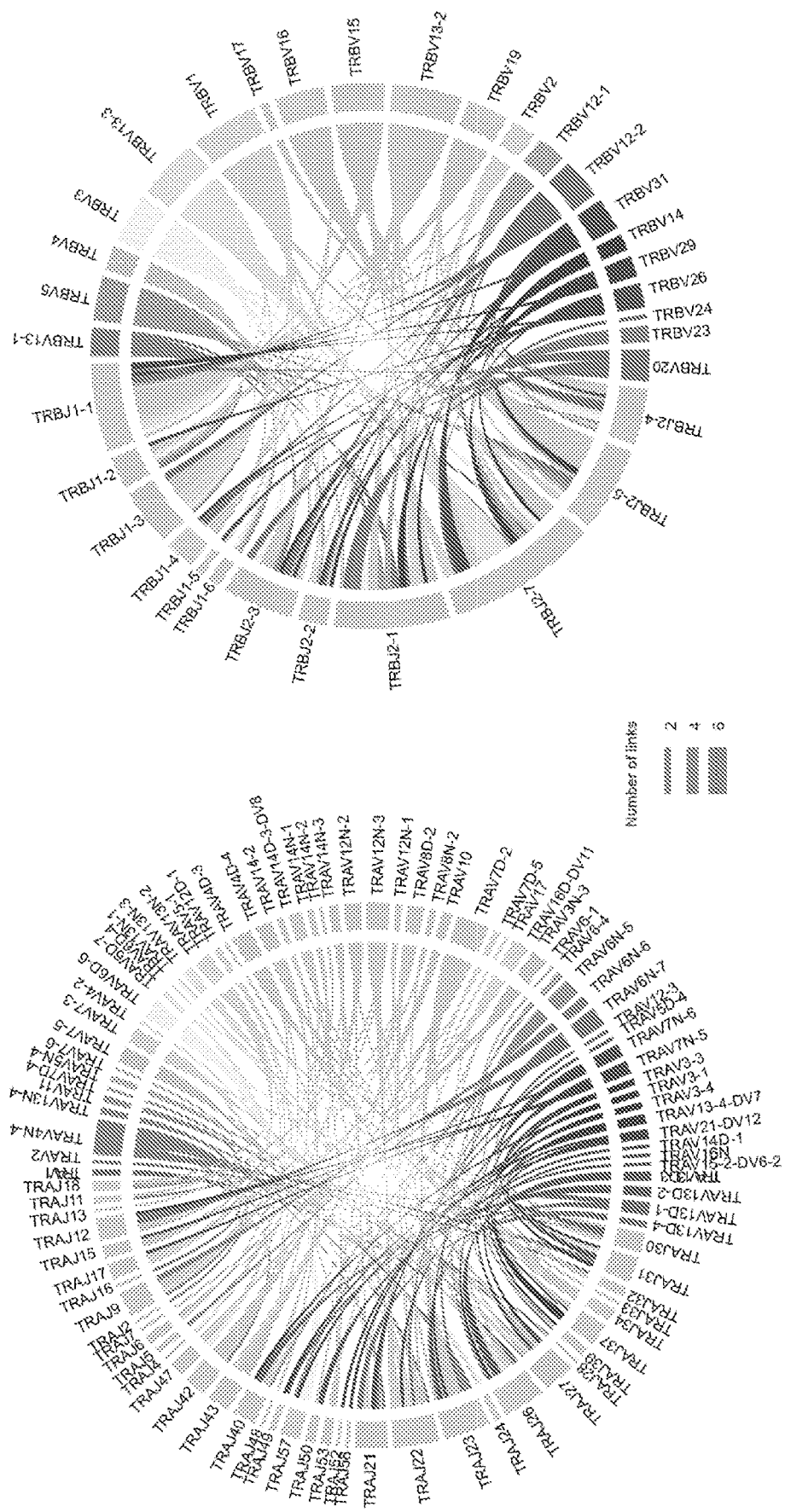
FIG. 11D shows circos plots of the linkages between the two segments in the alpha chain (top) and beta chain (bottom). Segment J's coded in grey and segment V's are differentially shaded. Ribbons link two chains with thickness proportional to the number of corresponding V/J pairs observed, and with the shading identical to the V chain.

Towards this end, Applicants infected mice with *Listeria* and FACS-sorted single CD4 T cells for transcriptomics and TCR sequencing. Based on transcriptional profiles, T cells clustered into distinct functional states (FIG. 11A), with a distinct profile for activated Th1 cells expressing Ifnγ (FIG. 11B) and Tbx21 (FIG. 11C). Amongst these T cells, the TCR repertoire was remarkably diverse with a maximal clonal frequency of ~2% (FIG. 11D).

Figure 12A:
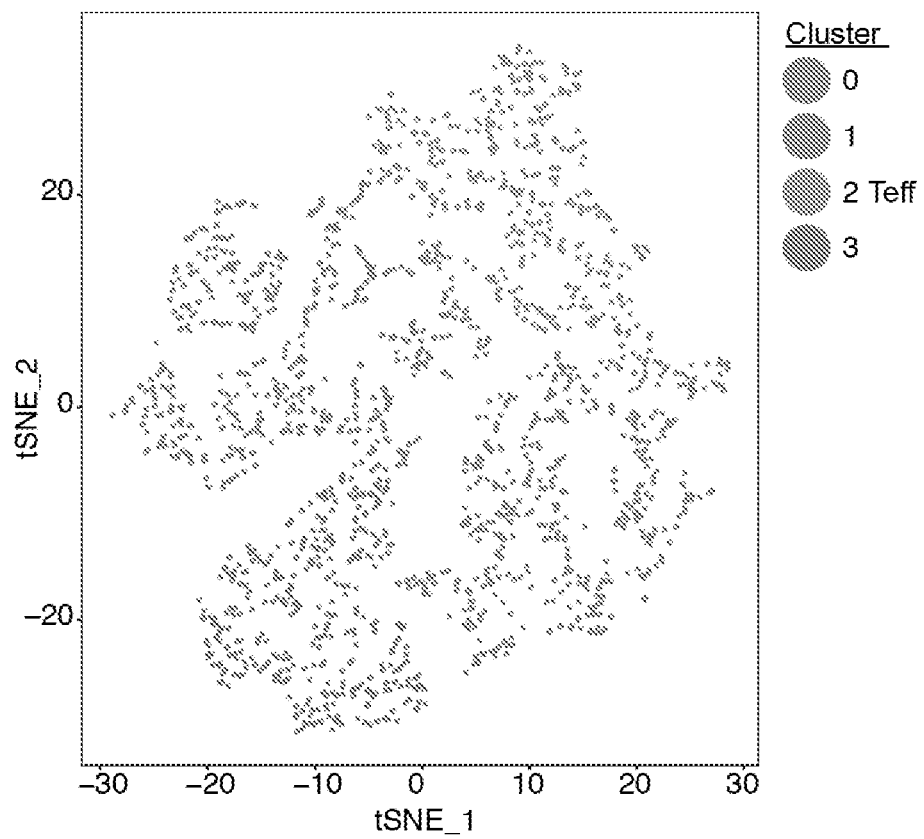
FIG. 12A shows a tSNE plot derived from T cell transcriptomes identifies distinct cell states that cluster according to unique signatures. Each dot represents a single cell that is shaded according to gene signature.
Figure 12B:
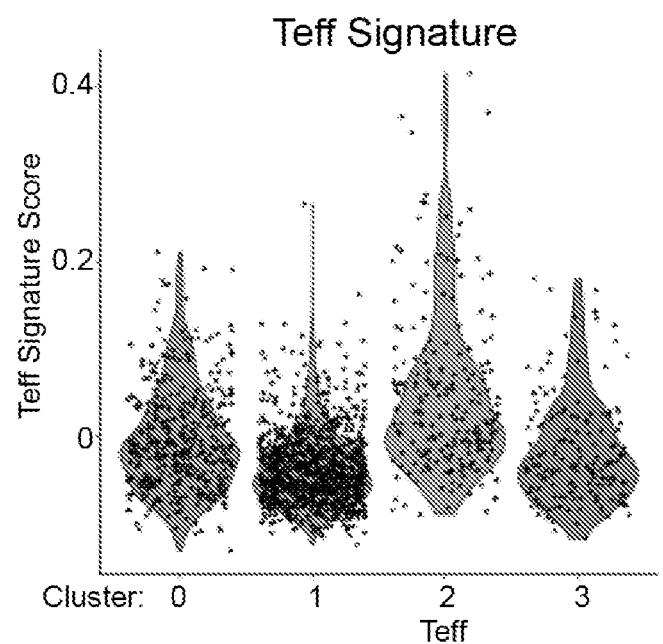
FIG. 12B shows violin plots displaying Teff signature score derived from ImmGen. Each dot represents a single cell classified by clusters defined by tSNE.
Figure 12C:
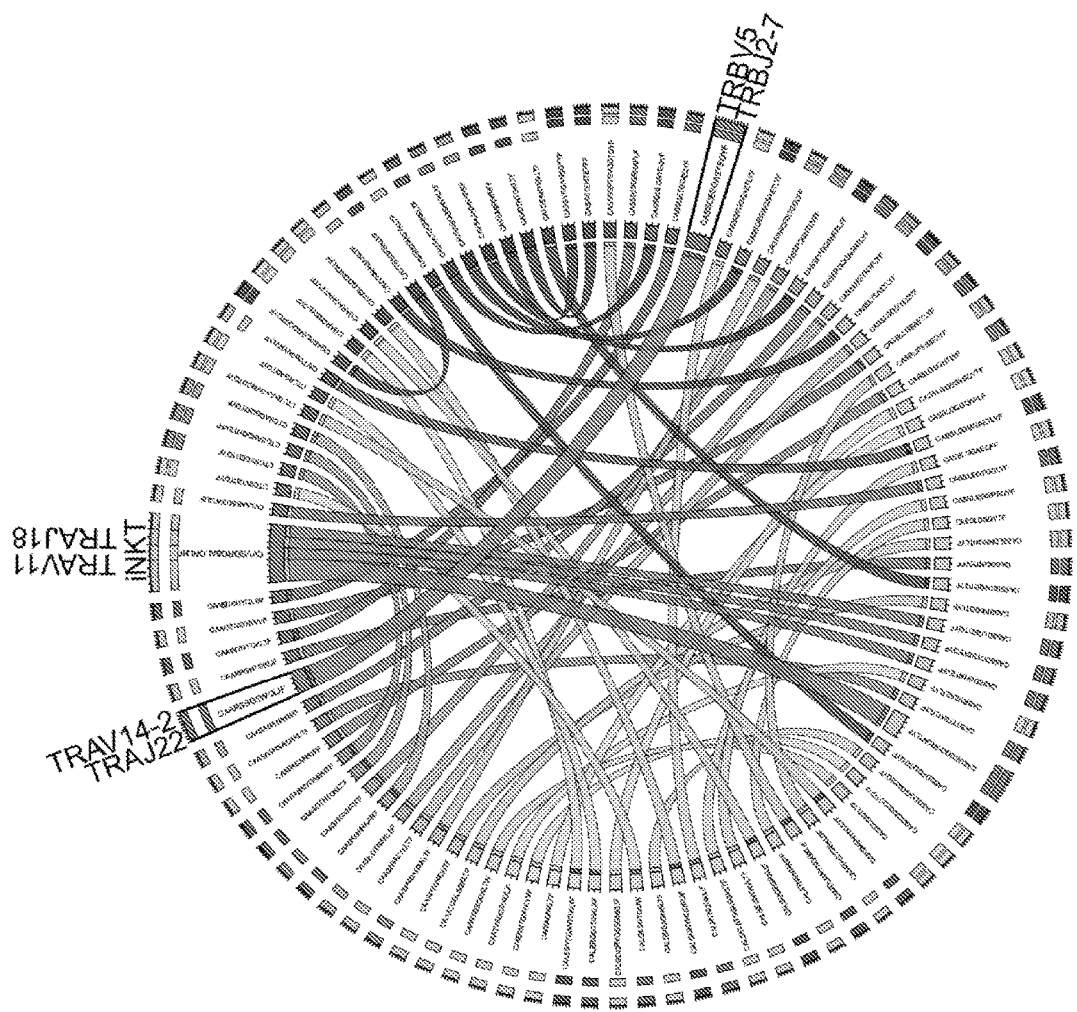
FIG. 12C shows circos plots of the linkages between the TCR alpha chain CDR3 and TCR beta chain CDR3. Ribbons link two chains with thickness proportional to the number of corresponding TCR pairs observed. Dominant TCR clones are labeled according to TCR gene segment usage. Starting with the sequence listed next to the TRBV5/TRBJ2-7 TCR, the plot lists SEQ ID NOs: 15101-15197, going in clock-wise order.

Based on unbiased clustering of transcriptional profiles, T cells partitioned into four distinct subsets (FIG. 12A). To identify the activated T effector (Teff) cluster, Applicants generated a per-cell Teff score that was based on the gene expression signature derived from ImmGen datasets comparing CD4 Teff splenocytes (day 8 after lymphocytic choriomeningitis virus, LCMV, infection) versus naïve CD4 T splenocytes (Heng et al., 2008). These analyses identified cluster 2 as being enriched for Teff cells expressing signature activation markers (Ccl5, Nkg7, Ikzf1), genes that regulate ER homeostasis (Calr, Pdia3), and genes that control cellular metabolism (Acly, Akr1a1) (FIG. 12B). Amongst these T cells, the TCR repertoire was remarkably diverse with a maximal clonal frequency of ~3% for conventional T cells. The most abundant conventional TCR (TRAV14-2TRAJ25|TRBV5TRBJ2-7) was detected exclusively in cells residing in Teff cluster 2. By contrast, NKT cells expressing the invariant alpha chain Trav11Traj18 were found scattered throughout clusters (FIG. 12C).

Figure 13A:
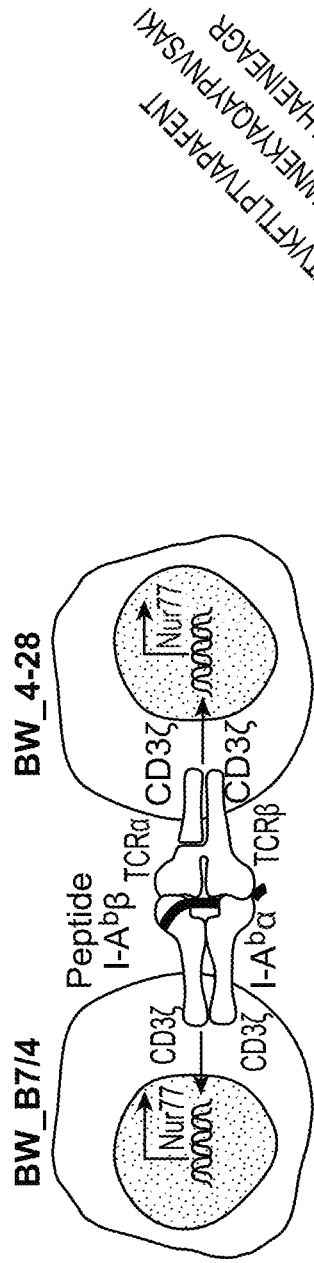
FIG. 13A shows the screen overview. BW5147_B7-4 cells were transduced to express peptide epitopes fused in-frame with the I-A$^b$beta chain bearing CD3zeta cytoplasmic domains. BW5147_CD4-28 cells were transduced to express chimeric single chain TCRs bearing the transmembrane and cytoplasmic domains of CD3zeta. In this coculture system, cognate antigen recognition results in T cell activation characterized by IL-2 production.
Figure 13B:
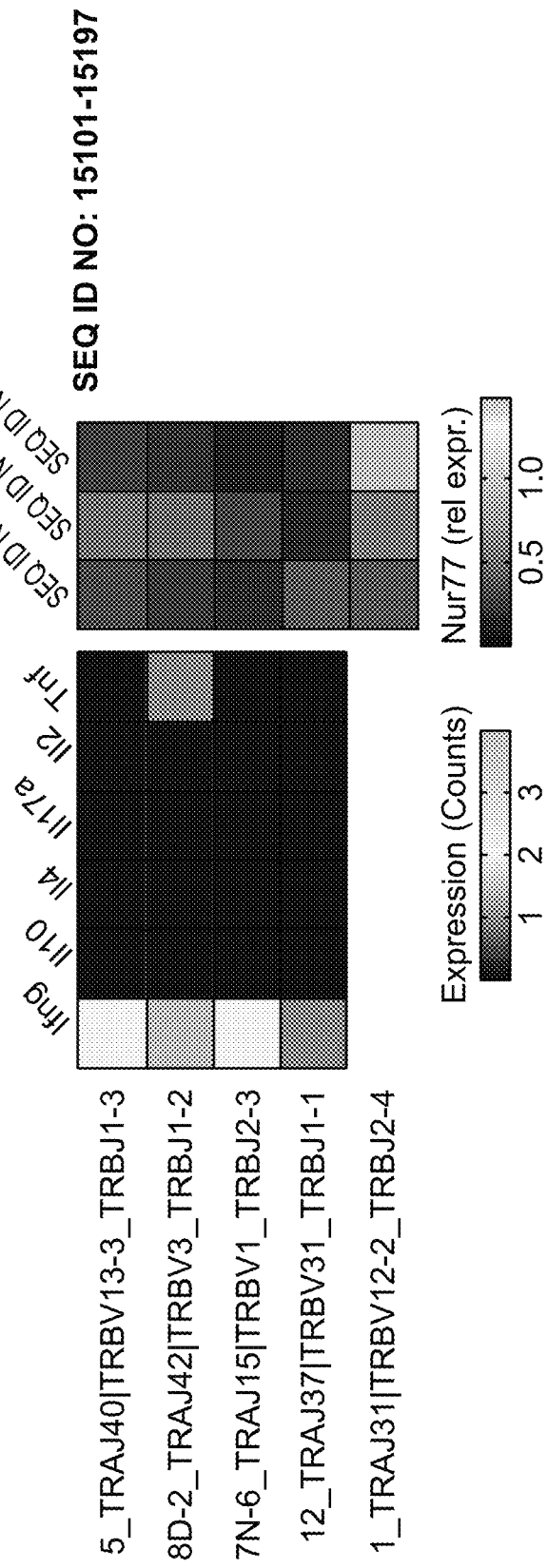
FIG. 13B shows that TCRs associated with high Ifng expression, as identified in CD4 T cells from *Listeria*-infected mice, were screened against *Listeria* epitopes. The positive control OT2 TCR reacted robustly with OT2 peptide I-A$^b$. T cell activation was measured in duplicate by induction of Nur77 expression relative to beta actin. The right side of panel B lists SEQ ID NOs: 15198-15200, from left to right.

Using TCRseq and whole transcriptome data, Applicants prioritized the most abundant TCR to test for reactivity against BOTA predictions (FIGS. 13A and 14A). In designing a screening modality, Applicants took into consideration the low affinity interaction between TCRs and peptide antigen presented on MHCII. This interaction occurs between multiple TCRs and pMHCII complexes within lipid bilayers on adjacent cells. Avidity and kinetics of engagement/disengagement elicit a TCR signaling cascade that amplifies the input signal. Therefore, Applicants designed a heterologous expression system in which TCR-negative BW5147-CD4-CD28 cells are transduced to express single chain TCRa and TCRβ fused to the cytoplasmic tail of CD3ζ. Functional TCRαβ proteins in BW5147-CD4-CD28 cells engage cognate peptide-MHCII on antigen presenting cells to initiate a TCR signaling response that results in expression of IL-2 or the activation marker Nur77 (Nr4al). As a source of surrogate antigen presenting cells, Applicants utilized HEK293T cells or BW5147-B7/4 cells transfected or transduced to express I-A$^b$α-CD3ζ and candidate peptide antigens fused to I-A$^b$β-CD3ζ. For HEK293T experiments, Applicants selected the most abundant TCR clone from TCRseq to test for reactivity with 4 Listeria pMHCII complexes predicted by BOTA (FIG. 14B). For BW5147-B7/4 experiments, Applicants generated 4 TCRs from TCRseq showing high IFN-γ expression and 2 Listeria pMHCII complexes predicted by BOTA (FIG. 13B). As a positive control, Applicants demonstrated that the OT2 TCR expressed in BW5147-CD4-CD28 cells reacted with ovalbumin peptide in the context of I-A$^b$ by inducing IL-2 secretion or Nur77 expression (FIGS. 13B and 14B) and IL-2 production. Among the four candidate Listeria-specific TCRs, three showed evidence of weak reactivity to LLO (FIG. 13B). Similarly, a previously identified TCR (LLO_118) (Weber et al., 2012) reacted robustly with LLO (FIG. 14B). The top TCR candidate identified by TCRseq also reacted with LLO, according to induction of IL-2 and binding to LLO-I-A$^b$ tetramers (FIGS. 14B and C). These findings are consistent with the notion that the primary T cell response to Listeria is characterized by numerous weakly-reactive TCRs. In agreement with this conclusion, the TCRseq experiments revealed a remarkably diverse TCR repertoire associated with the primary Th1 response to Listeria. Taken together, these experiments establish the feasibility of integrating population-level TCR repertoires with antigen specificity by screening individual TCRs for reactivity against candidate antigens predicted in silico.

Example 7—Identification of Commensal Epitopes

Figures 15A, 15B:
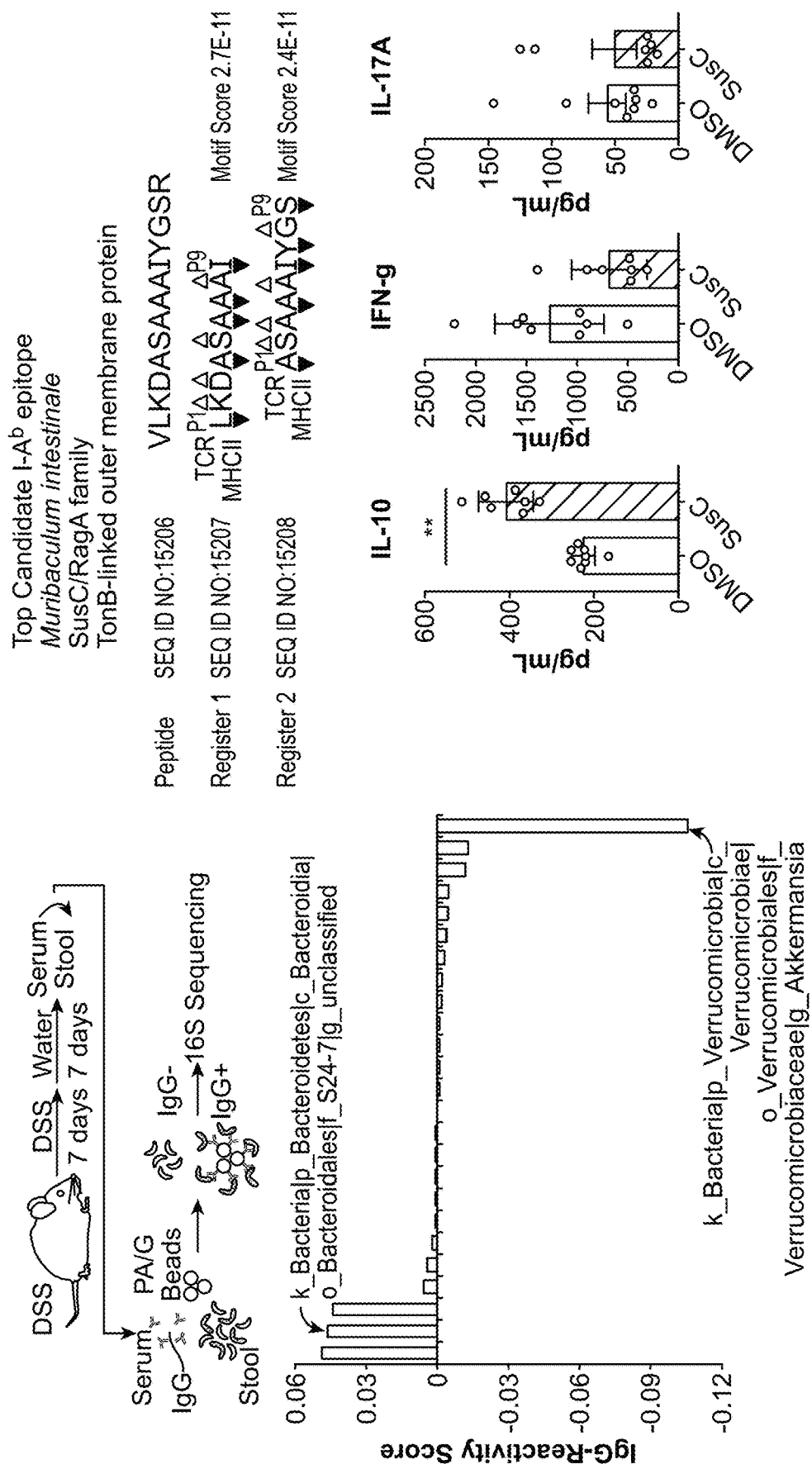
FIG. 15A shows that mice were administered DSS to induce colitis prior to analysis by SICC-seq. At day 14, serum was collected and incubated with stool to allow binding of IgG with commensals. IgG-positive and -negative fractions were separated with magnetic beads covalently attached to protein A/G. The immunogenicity of Bacteroidales was demonstrated by IgG-reactivity score (relative abundance in IgG-positive minus IgG-negative fractions) derived from 16 s sequencing.
FIG. 15B shows that BOTA identified SusC, a highly represented epitope within and a 1 cross Bacteroidales genomes, including the murine commensal *Muribaculum intestinale*. Splenocytes from naive mice were harvested and stimulated in vitro with the indicated peptide. Cytokines were measured 24 hours later by cytometric bead array. IL-10 production was selectively induced by SusC peptide, suggesting that host T cells recognize and tolerate Bacteroidales. Shown are SEQ ID NOs: 15206-15208, starting with the top peptide.

Having validated BOTA epitope predictions for a common pathogenic bacterium, Applicants sought to explore the complex relationship between commensal microbes and host adaptive immunity. In this context, the intestinal microbiome fine-tunes inflammatory thresholds, primes innate immune effector function, and shapes the adaptive immune response through selection and tolerization of lymphocytes (Palm et al., 2015). Thus, the dynamic role of the microbiome in immune education impacts organ systems throughout the body, and in turn, many disease states (Hall et al., 2017). Applicants reasoned that because the host adaptive immune system continuously interacts with the microbiome, monitoring the magnitude and nature of the T cell response to specific commensal antigens can reveal the health status of the immune system. In the state of health, the adaptive immune system maintains tolerance to local gut antigen exposure and protection from systemic infection. The sheer number of bacterial species and diversity of protein-coding elements in the microbiome represents an enormous search space. Towards identifying immunogenic commensals, Applicants developed "serum immunoglobulin commensal capture and sequencing" (SICC-seq). Mice were administered a course of dextran sodium sulfate (DSS) to induce barrier breach and allowed to recover for 7 days. Serum was then harvested from mice and incubated with stool to opsonize commensals. IgG-positive microbes were enriched by selection with Protein A/G-coupled magnetic beads and analyzed along with total stool by 16S rRNA sequencing. Using this approach, Applicants demonstrated that induction of colitis with DSS elicits a systemic T cell-dependent IgG response that preferentially targets bacteria in the genus Bacteroidales (FIG. 15A). In contrast, Akkermansia evade this response, likely due to their ability to induce T cell tolerance and IgA responses under homeostatic conditions (before colitis) (FIG. 15A). Having established the immunogenicity of Bacteroidales, Applicants employed BOTA to predict T cell epitopes from the dominant species inhabiting mice (Ormerod, et al., 2016) (FIG. 15B) and identified a highly abundant epitope in a SusC-like protein that is conserved across the Bacteroidales genus and often duplicated within species (FIGS. 15B and 22). To determine if T cells recognize this SusC epitope in vivo, Applicants harvested splenocytes from a naïve mouse and stimulated them with SusC peptide in vitro. Importantly, the SusC peptide induced IL-10 production by T cells, indicating a homeostatic relationship between host T cells and Bacteroidales in a normal healthy mouse (FIG. 15C). Applicants hypothesize that these interactions extend to many other commensals, and that tumultuous relationships between T cells and commensals typify immune pathologies and autoimmunity.

Example 8—Discussion

Host-microbe interactions cooperatively influence the specificity and diversity of the T cell response. A deeper understanding of this relationship requires new approaches for unbiased antigen discovery, defining the features of antigenicity, and elucidating host pathways underlying preferential selection of these features. Toward these objectives, Applicants report a highly quantitative adaptation of MHCII peptidomics. By recapitulating the interaction between primary murine BMDCs and live L. monocytogenes, Applicants identified four dominant CD4 T cell epitopes and established their immunodominance hierarchy in vivo. In addition, MHCII peptidomics identified over 3600 autologous mouse peptides, which provided an exceptionally detailed view of lysosomal function.

As a consequence of deep profiling of the MHCII immunopeptidome, Applicants generated a rich dataset for identifying features associated with of antigen processing and developed BOTA as a predictive algorithm, incorporating several important attributes of immunodominant epitopes revealed by proteomics. Based on observations from MHCII peptidomics, optimal epitopes tend to (1) derive from secreted proteins or extracellular regions of cell wall proteins in bacteria, (2) have a primary sequence structure that conforms to a defined MHCII binding motif, (3) be located more than 8 amino acids away from transmembrane domains, and (4) have tertiary structure characteristics that promote accessibility to the MHCII binding groove and the enzymes required for proteolytic processing. Notably, Applicants did not identify any features of antigenicity associated with protease specificity, as lysosomal endopeptidases and exopeptidases are highly diverse with respect to substrate selectivity. Importantly, all of the features identified by peptidomics are readily identifiable at the level of DNA sequence; therefore, the only input requirement for BOTA is an annotated genome. Owing to this, BOTA enables large-scale mapping of the immunodominant epitope landscape for any bacterial species or collection of species, such as the human microbiome. Taken together, Applicants demonstrate the utility of MHCII peptidomics for training a deep neural network that specifically identifies candidate epitopes with key features associated with immunodominance and antigenicity. Furthermore, MHCII peptidomics serves as a powerful tool for unbiased discovery of complex pathogen antigens and for interrogation of host pathways underlying human disease.

Inherent to antigen discovery is the significant challenge of validating epitope predictions. Conclusive validation of epitope immunogenicity requires demonstration that a measurable T cell response is elicited in vivo. To address this challenge, Applicants developed an approach for identifying and integrating TCR repertoire, phenotype, and antigen reactivity. Coupling TCRseq with whole transcriptome profiling enabled at the single cell level enabled assignment of transcriptional phenotypes to individual TCRs. While Applicants employed this approach to identify TCRs associated with CD4 T effector cells (e.g., Th1 cells) derived from *Listeria*-infected mice, it is applicable to any immune cell type and any phenotype that can be defined at the level of the transcriptome, including Treg or Th17. Such determinations are challenging in T cell hybridomas because the primary T cell phenotype is not preserved after immortalization. Moreover, generating T cell hybridomas is an inefficient process that is further biased by chromosome loss, drug selection, and screening for antigen reactivity. In contrast, TCRseq is comparatively efficient, which is an important consideration in the context of limited T cell input from precious clinical specimens. A small tissue biopsy is sufficient to generate a permanent archive of TCR sequences matched with transcriptional profiles that can be used to screen defined TCRs for reactivity against candidate epitopes. Thus, immunodominance can be unambiguously defined in the context of epitopes that elicit the strongest T cell responses, as determined by clonal frequency and/or absolute numbers.

Figure 18:
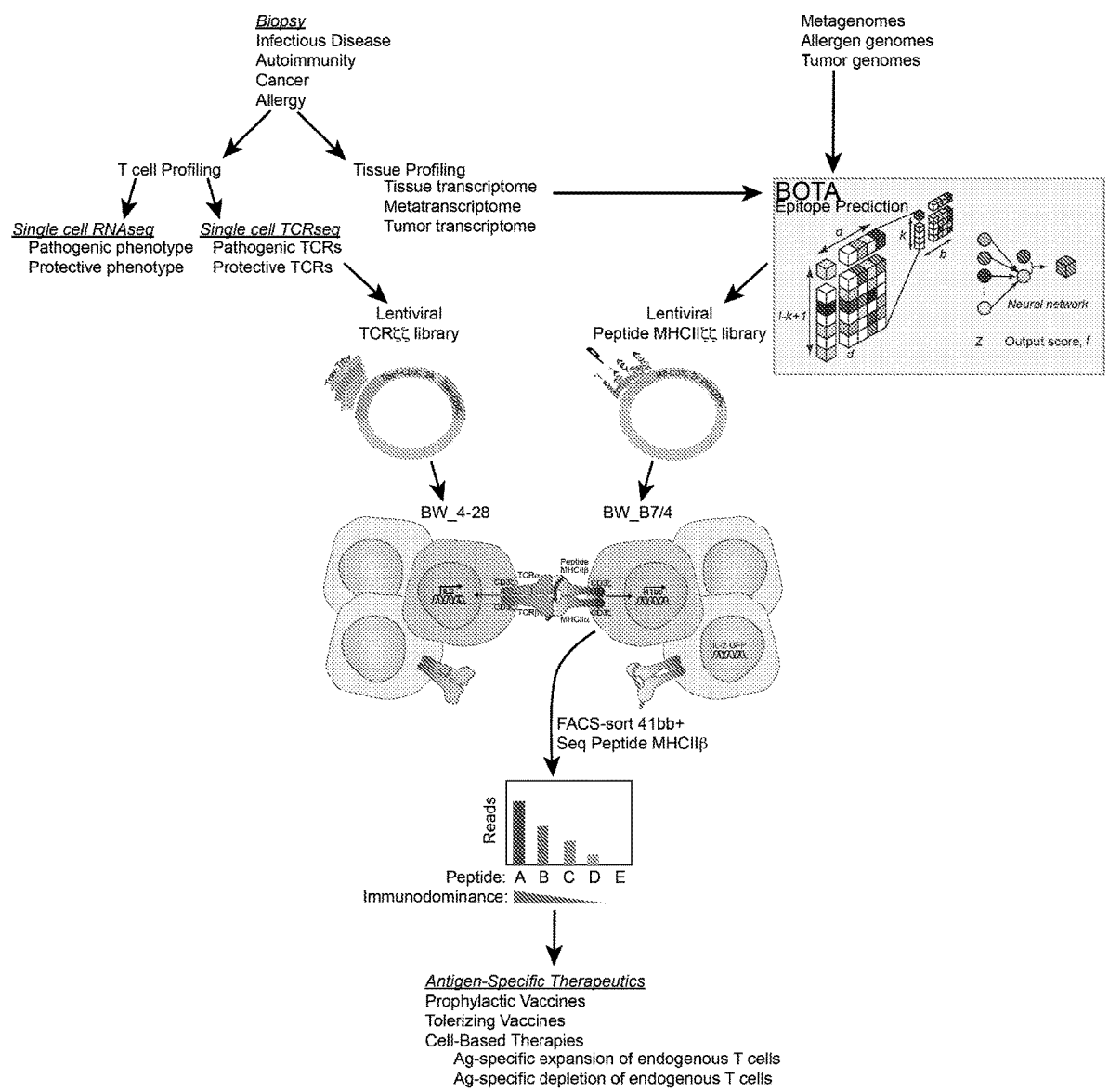
FIG. 18—BOTA Applications: Strategy for specifying immunodominance hierarchies at scale.
Figure 19A:
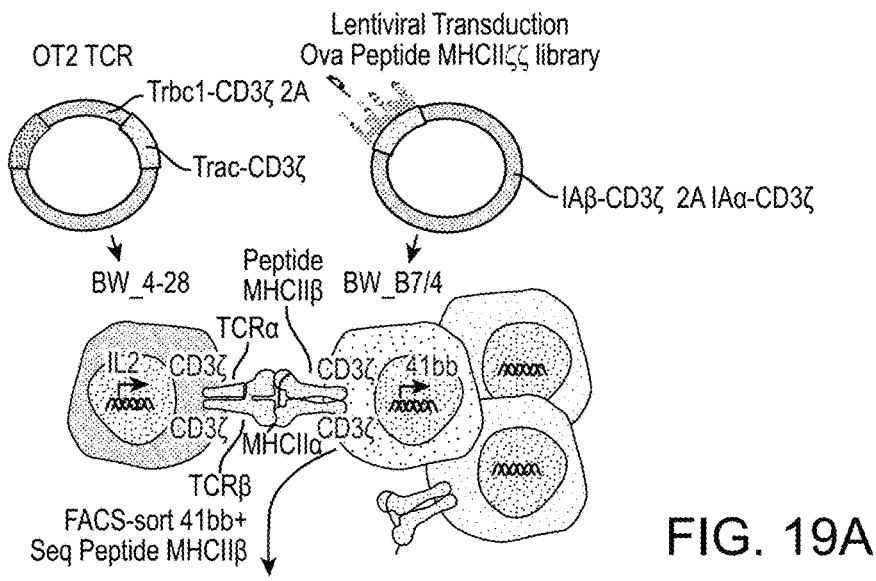
FIG. 19A shows an example schematic overview. Peptide-MHCIIζζ cDNA libraries encoding mutated ovalbumin peptides (Ova 323-339) were delivered to BW_B7/4 T cells by lentiviral transduction. These responder cells were cocultured with BW_4-28 stimulator cells expressing a single chain OT2
Figure 19B:
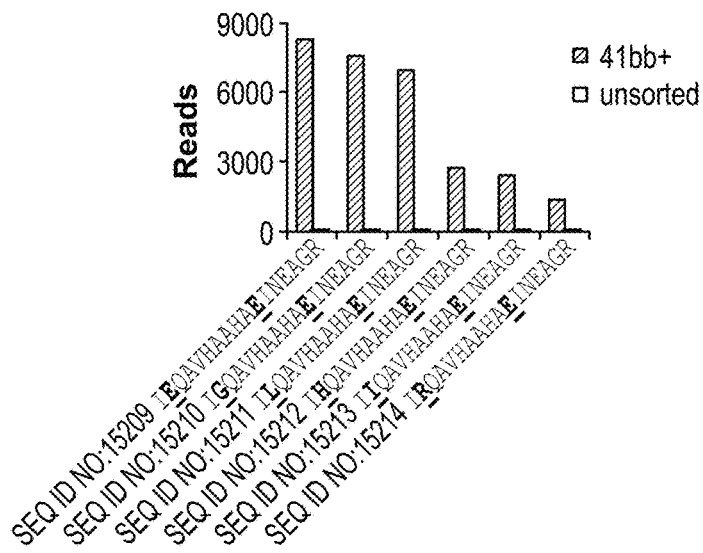
FIG. 19B shows that Illumina sequencing reads were translated in silico and quantified to compare the abundances of Ova-encoding mutants within the 41bb+ samples relative to unsorted samples. Shown are SEQ ID NOs: 15209-15214, from left to right.
Figure 19C:
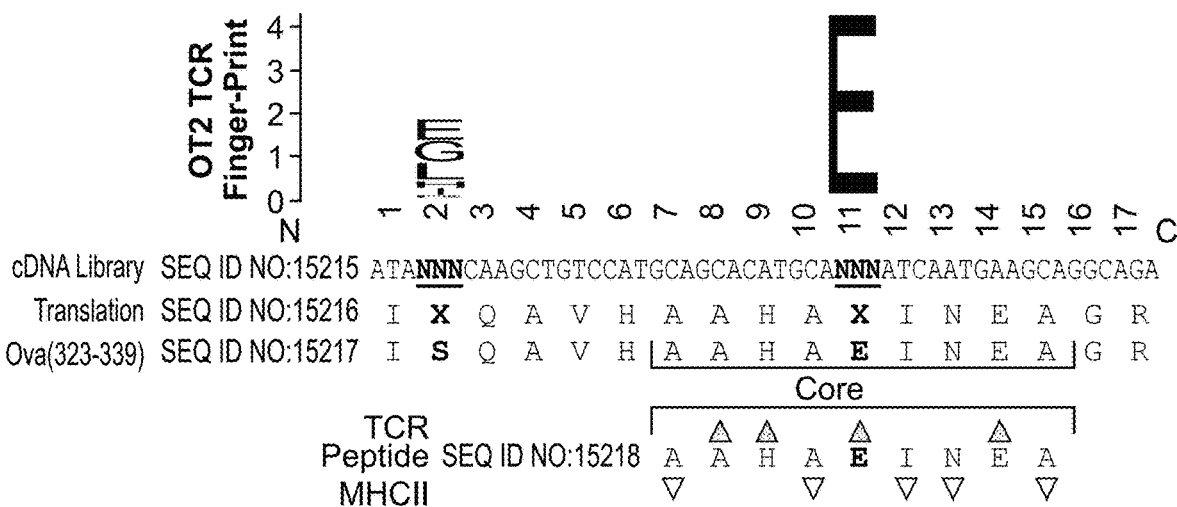
FIG. 19C shows that a glutamate at amino acid position 11 in Ova (323-339) is strictly required for functional interaction with the OT2 TCR. This position represents an outward-facing TCR contact reside within the core MHCII-binding register of Ova(323-339). In contrast, position 2 of Ova(323-339) falls within a region flanking the core MHCII-binding motif and can accommodate several different amino acids while retaining functional interaction with the OT2 TCR. This observation is consistent with the notion that position 2 does not contribute to recognition by the OT2 TCR. Shown are SEQ ID NOs: 15215-15218, starting with the top sequence.

Here, Applicants develop a technology platform with broad utility for antigen discovery. BOTA is capable of predicting CD4 T cell epitopes from multiple sources, including genomes or transcriptomes derived from pathogens, the microbiome, allergens, tumors, and tissue biopsies (FIG. 18). By coupling BOTA predictions with TCRseq from matching specimens, Applicants enable generation of DNA-encoded epitope and TCR libraries that can be screened to define antigen specificity and quantify immunodominance. The screening platform developed can be implemented in arrayed format (well-based screening of individual TCRs by peptide-MHCII antigens) or in a pooled format where cells expressing TCR libraries are cocultured with cells expressing peptide-MHCII libraries. For example, Applicants have performed TCR fingerprinting by coculturing stimulator cells expressing the OT2 TCR with responder cells displaying a library of ovalbumin peptide mutants expressed as a fusion protein with MHCII ectodomain linked to the CD3ζ cytoplasmic domain. After FACS-sorting activated responder cells (41bb+) that had engaged in a productive interaction with stimulator cells, Applicants sequenced the Ova-MHCIIζ libraries to recover the known cognate peptide ligand for the OT2 TCR (FIG. 19). In this context, it is possible to simultaneously screen thousands of epitopes for reactivity with a given TCR.

With the new approaches to effectively predict T cell epitopes and validate TCR reactivity as disclosed herein, it is possible to identify antigenic determinants in bacterial pathogens and even complex communities such as the intestinal microbiome. Applicants identified an I-$A^b$-restricted epitope in a SusC-like protein derived from Bacteroidales that is associated with IL-10 producing T cells derived from mouse spleen. Notably, these experiments identified systemically circulating T cells with reactivity to a benign commensal species. The findings highlight the intimate relationship between commensals and the host adaptive immune system. In this context, previous studies in mouse models have demonstrated that a systemic T cell-dependent IgG response to commensals is cross-protective against pathogen infection (Zeng et al., 2016). Similarly, IgG-reactivity with commensals has been shown to be widespread in healthy humans and qualitatively perturbed in the context of autoimmunity (Christmann et al., 2015; and Stoll et al., 2014). While the understanding of host-commensal mutualism is in its infancy, future research stands to reveal how this relationship promotes homeostatic immune regulation or precipitates immune dysfunction. New approaches to antigen discovery portend opportunities for biomedical research, including vaccine development (prophylactic or tolerizing) and antigen-specific T cell therapies aimed at expanding or deleting endogenous T cells with defined antigen specificities.

The improvement on prediction accuracy by BOTA also signifies the successful application of deep neural network in solving complex biomedical problems. Previous efforts using traditional neural networks or hidden Markov Models were limited by their ability to extract highly abstract features, thus leading to insufficient insights into epitope prediction. The important innovation of BOTA, is that it can be utilized to predict CD4 T cell epitopes for virtually any MHCII allele and any antigen-source, including commensal microbes, pathogens, autoantigens, and tumor antigens. Taken together, Applicants demonstrate the utility of MHCII peptidomics for training a deep neural network that specifically identifies candidate epitopes with key features associated with immunodominance. Furthermore, MHCII peptidomics serves as a powerful tool for unbiased discovery of complex pathogen antigens and for interrogation of host pathways underlying human disease.

TABLE 1

*Listeria* epitopes discovered by MHCII peptidomics.

| SEQ ID NO: | Listeria peptide[a] | logFC[b] | adj.P.Val[c] | entry_name | core | score[d] |
|---|---|---|---|---|---|---|
| 14980 | WNEKYAQAYPNVS | 1.37728 | 7.0568E-18 | lmo0202 (hly) (LLO) | EKYAQAYPN | 9.728E-11 |
| 14981 | WNEKYAQAYPNVSAKI | 1.20234 | 1.0840E-13 | lmo0202 (hly) (LLO) | EKYAQAYPN | 9.728E-11 |

TABLE 1-continued

Listeria epitopes discovered by MHCII peptidomics.

| SEQ ID NO: | Listeria peptide[a] | logFC[b] | adj.P.Val[c] | entry_name | core | score[d] |
|---|---|---|---|---|---|---|
| 14982 | ........VERWNEKYAQAYPNVS.................... | 0.28494 | 1.6720E-01 | lmo0202 (hly) (LLO) | EKYAQAYPN | 9.728E-11 |
| 14983 | .........ERWNEKYAQAYPNVS.................... | 0.20689 | 3.6222E-01 | lmo0202 (hly) (LLO) | EKYAQAYPN | 9.728E-11 |
| 14984 | ....APGQETQHYYGLPVADSAIDR................... | 0.85608 | 3.3989E-07 | lmo2558 (ami) | YGLPVADSA | 6.385E-11 |
| 14985 | ......VWTKPNKIEGAQKISALSTY................. | -0.26248 | 2.1661E-01 | lmo2558 (ami) | WTKPNKIEG | 1.641E-11 |
| 14986 | .......ADFRYVFDTAKATAASSYPG................. | 1.56572 | 6.8456E-23 | lmo2185 | FDTAKATAA | 1.932E-10 |
| 14987 | .......ADFRYVFDTAKATAASSYPGSDETPP.......... | 1.55744 | 1.0148E-22 | lmo2185 | FDTAKATAA | 1.932E-10 |
| 14988 | ........DFRYVFDTAKATAASSYPGSDETPP.......... | 0.67777 | 9.6362E-05 | lmo2185 | FDTAKATAA | 1.932E-10 |
| 14989 | ..........RYVFDTAKATAASSYPGSDETPPVVNPGETNPP | 0.63438 | 3.1562E-04 | lmo2185 | ETPPVVNPG | 2.208E-10 |
| 14990 | ...........YVFDTAKATAASSYPGSDETPP.......... | 0.61121 | 5.4781E-04 | lmo2185 | FDTAKATAA | 1.932E-10 |
| 14991 | ..........RYVFDTAKATAASSYPGSDETPP.......... | 0.27084 | 1.9678E-01 | lmo2185 | FDTAKATAA | 1.932E-10 |
| 14992 | ........YPGSDETPPVVNPGE................... | 0.78521 | 3.8293E-06 | lmo2185 | ETPPVVNPG | 2.208E-10 |
| 14993 | ......SSYPGSDETPPVVNPGETNPP............... | 0.29186 | 1.5520E-01 | lmo2185 | ETPPVVNPG | 2.208E-10 |
| 14994 | ........YPGSDETPPVVNPGETN.................. | 1.86133 | 3.1731E-32 | lmo2185 | ETPPVVNPG | 2.208E-10 |
| 14995 | ......EVEDLNQPLAAHVNYE.................... | 0.15261 | 5.2950E-01 | lmo2185 | PLAAHVNYE | 4.828E-11 |
| 14996 | .....AVDDTTVKFTLPTVAPAFENT................. | 0.87086 | 1.9984E-07 | lmo0135 | FTLPTVAPA | 5.607E-09 |
| 14997 | ......VDDTTVKFTLPTVAPAFENT................. | 0.84368 | 5.3557E-07 | lmo0135 | FTLPTVAPA | 5.607E-09 |
| 14998 | .......DDTTVKFTLPTVAPAFENT................. | 0.78647 | 3.6883E-06 | lmo0135 | FTLPTVAPA | 5.607E-09 |
| 14999 | .....AVDDTTVKFTLPTVAPAFENTIK............... | 0.46417 | 1.2352E-02 | lmo0135 | FTLPTVAPA | 5.607E-09 |
| 15000 | ......VDDTTVKFTLPTVAPAFE................... | 0.45544 | 1.4456E-02 | lmo0135 | FTLPTVAPA | 5.607E-09 |
| 15001 | .......DDTTVKFTLPTVAPAFE................... | 0.38746 | 4.5231E-02 | lmo0135 | FTLPTVAPA | 5.607E-09 |
| 15002 | .......DDTTVKFTLPTVAPAFEN.................. | 0.25955 | 2.2271E-01 | lmo0135 | FTLPTVAPA | 5.607E-09 |
| 15003 | .........TTVKFTLPTVAPAFENT................. | 0.0598 | 8.4126E-01 | lmo0135 | FTLPTVAPA | 5.607E-09 |
| 15004 | .........DGLTWHDGKPLTADDV.................. | 1.01543 | 6.5055E-10 | lmo0135 | WHDGKPLTA | 1.053E-10 |
| 15005 | ........GTKEKVVATPVSNVSTSSA................. | 0.4888 | 7.7931E-03 | lmo0186 | VATPVSNVS | 4.923E-10 |
| 15006 | ........TKEKVVATPVSNVSTSS.................. | -0.2861 | 1.6535E-01 | lmo0186 | VATPVSNVS | 4.923E-10 |
| 15007 | .........KEKVVATPVSNVSTSS.................. | -0.20956 | 3.5407E-01 | lmo0186 | VATPVSNVS | 4.923E-10 |
| 15008 | ........GTKEKVVATPVSNVST................... | 0.03708 | 9.0585E-01 | lmo0186 | VATPVSNVS | 4.923E-10 |
| 15009 | .......GGINQAYTGSTALSDGLN.................. | 0.55469 | 2.0548E-03 | lmo2360 | YTGSTALSD | 7.495E-11 |
| 15010 | ........GINQAYTGSTALSDG.................... | 0.26067 | 2.2070E-01 | lmo2360 | YTGSTALSD | 7.495E-11 |
| 15011 | .......GGINQAYTGSTALSDG.................... | 0.23863 | 2.7631E-01 | lmo2360 | YTGSTALSD | 7.495E-11 |
| 15012 | .........STVVVEAGDTLWGIAQSKGTT............. | 0.48949 | 7.6998E-03 | lmo0582 (lap) | VEAGDTLWG | 3.576E-12 |
| 15013 | ........IAVTAFAAPTIASA.................... | 0.18053 | 4.4262E-01 | lmo0582 (lap) | FAAPTIASA | 8.274E-09 |
| 15014 | ........VETKADIDALSLLSDKIFVTNQT............ | 1.05574 | 1.1992E-10 | lmo1451 (ispH) | DIDALSLLS | 1.864E-11 |

TABLE 1-continued

Listeria epitopes discovered by MHCII peptidomics.

| SEQ ID NO: | Listeria peptide[a] | logFC[b] | adj.P.Val[c] | entry_name | core | score[d] |
|---|---|---|---|---|---|---|
| 15015 | .......EAKELVDNAPKALKEGIA............... | 0.9296 | 2.0391E-08 | lmo0251 (rplL) | DNAPKALKE | 1.319E-10 |
| 15016 | .....SNVNHVLDIGYGGGSnVKN............... | 0.227 | 3.0478E-01 | lmo1715 | IGYGGGSnV | 1.796E-12 |
| 15017 | ............EVVYHNMKQDLE............... | -0.17079 | 4.7439E-01 | lmo2411 | EVVYHNMKQ | 5.047E-14 |
| 15018 | DGLKAGEHFFAAGKDWPDAIYANGDEVAAGVmYH........ | -0.42712 | 2.3527E-02 | lmo2737 | KDWPDAIYA | 4.863E-11 |
| 15019 | ...........EILLQKPnGERLTSFITL............ | -0.04842 | 8.7532E-01 | lmo0429 | ILLQKPnGE | 2.664E-12 |
| 15020 | ..........GLLmAKKYKMNLTIVIVN........... | -0.62908 | 3.$620E-04 | lmo1675 (menD) | AKKYKMNLT | 1.150E-12 |
| 15021 | .......TVRAKSKTYPVYInEFALE............. | 0.14445 | 5.5769E-01 | lmo1927 (aroB) | KTYPVYInE | 1.187E-10 |
| 15022 | ..........mNRVmLPLQQmGAKMHGK............ | 0.14475 | 5.5742E-01 | lmo1923 (aroE) | VmLPLQQmG | 2.556E-13 |
| 15023 | ............VMASDYTRGLSIRAIELVFEnL........ | 0.25073 | 2.4351E-01 | lmo1634 | VMASDYTRG | 6.973E-12 |
| 15024 | .......YMEKHSVSRLVGAPP................. | -0.4422 | 1.8422E-02 | lmo2206 (clpB) | VSRLVGAPP | 3.965E-12 |
| 15025 | ........KTASGIVLPDSAKEKPQSGKIVAVGSGRVLD.... | -0.49627 | 6.8168E-03 | lmo2069 (groES) | IVLPDSAKE | 4.253E-11 |
| 15026 | ..........ESVYLSAQKEnPRLFAKIETF.......... | 0.59506 | 8.1895E-04 | lmo1574 (dnaE) | SVYLSAQKE | 2.233E-11 |
| 15027 | ........RDNYLFQLYEATGTPIHPmSPF............ | -0.05049 | 8.7162E-01 | lmo2712 | FQLYEATGT | 5.383E-11 |

[a] Peptide modifications: oxidized Met (m), deamidated-N (n), and acetyl (k or n-term).
[b] Log2 Fold Change Listeria 6 hr versus 10 min.
[c] Cutoff:alpha = 0.00005
[d] Score based on conformation to I-Ab-binding motif. Max = 9.9E$^{-8}$. Cutoff = 9.0E$^{-11}$.

TABLE 2

Listeria epitopes predicted by BOTA

| SEQ ID NO: | BOTA Prediction (Listeria) | gene name | BOTA score | Motif score | Peptidomics Hit |
|---|---|---|---|---|---|
| 15028 | .....ERWNEKYAQAYPNVSAKID... | lmo0202 (hly) (LLO) | 0.557556 | 9.728E-11 | ..........WNEKYAQAYPNVS......... |
| 15029 | ....ETQHYYGLPVADSAIDRGPL... | lmo2558 (ami) | 0.675373 | 6.385E-11 | ...APGQETQHYYGLPVADSAIDR......... |
| 15030 | .....FRYVFDTAKATAASSYPGS... | lmo2185 | 0.760419 | 1.932E-10 | ......ADFRYVFDTAKATAASSYPG....... |
| 15031 | ....DTTVKFTLPTVAPAFENTIKT.. | lmo0135 | 0.532495 | 5.607E-09 | ......AVDDTTVKFTLPTVAPAFENT...... |
| 15032 | ......EKVVATPVSNVSTSSATSS.. | lmo0186 | 0.616773 | 4.923E-10 | ........GTKEKVVATPVSNVSTSSA...... |
| 15033 | .....INQAYTGSTALSDGLNKM.... | lmo2360 | 0.481871 | 7.495E-11 | ..........GGINQAYTGSTALSDGLN........ |
| 15034 | ...GIAVTAFAAPTIASASTVVV.... | lmo0582 (lap) | 0.671301 | 8.274E-09 | .......IAVTAFAAPTIASA............ |
| 15035 | ....AKELVDNAPKALKEGIA...... | lmo0251 (rpll) | 0.744982 | 1.319E-10 | .........EAKELVDNAPKALKEGIA......... |
| 15036 | ...TVRAKSKTYPVYINEFALED.... | lmo1927 (aroB) | 0.650328 | 1.187E-10 | ..........TVRAKSKTYPVYInEFALE........ |
| 15037 | ....YHGPIFLNASLSGVLE....... | lmo0201 (plcA) | 0.544155 | 6.548E-11 | N/A |
| 15038 | .....FGTHNVSSLSSGALNVHA.... | lmo0551 | 0.367349 | 5.869E-11 | N/A |
| 15039 | ...ANGDLYNAETSQYLGRL....... | lmo0682 | 0.389302 | 5.763E-11 | N/A |
| 15040 | ......YELPKLPYTYDALE....... | sod | 0.463634 | 8.126E-11 | N/A |

TABLE 2-continued

Listeria epitopes predicted by BOTA

| SEQ ID NO: | BOTA Prediction (Listeria) | gene name | BOTA score | Motif score | Peptidomics Hit |
|---|---|---|---|---|---|
| 15041 | YIKKYDGDLKLALAAYNAG | lmo0717 | 0.537408 | 1.079E-10 | N/A |
| 15042 | .FLITMAPEFPYLKPGSA | lmo1883 | 0.547697 | 9.833E-11 | N/A |
| 15043 | ......PKSTVSSATSTAQ | lmo0551 | 0.445178 | 1.292E-10 | N/A |
| 15044 | .....YPYVFGGSSPSTS | lmo1104 | 0.517277 | 5.014E-10 | N/A |

Materials and Methods

Immuno-affinity purification of MHCII complexes. Bone marrow was harvested from C57/BL6 (WT), Atg16l1$^{f/f}$×CD11c-Cre (Conway et al., 2013b), and Atg5$^{f/f}$×CD11c-Cre (Conway et al., 2013a) mice. BMDCs were differentiated from bone marrow for seven days in antibiotic-free DMEM supplemented with 20% FBS and GM-CSF (2% conditioned TOPO medium). In parallel, L. monocytogenes strain EGDe (ATCC BA-679) was cultured overnight in BHI medium, washed in PBS, and cocultured with BMDCs at an MOI of approximately 100:1 for 30 minutes. Tissue culture dishes containing cocultures were washed in PBS and cultured for an additional 10 minutes or 6 hours in DC media containing gentamicin (30 µg/ml). BMDCs were then harvested by scraping, washed in PBS, and lysed in 1% NP-40, 4 mM MgCl$_2$, 6 µg/ml DNaseI from bovine pancreas (Sigma Aldrich), and PBS pH 7.4 at 250×10$^6$ cells/4 ml lysis buffer/sample. Clarified lysates were subjected to immunoprecipitation overnight at 4° C. with gentle rotation. Immunoprecipitation was performed with NHS Mag Sepharose (GE Healthcare) covalently coupled to anti-H2-IA (clone Y3P (Janeway et al., 1984)). Each sample contained 130 µl packed beads and approximately 650 µg antibody. Beads were then washed twice in PBS containing 0.1% NP-40 and three times in PBS.

MHC-peptide elution and desalting. Peptides were eluted from MHC complexes and desalted on in-house-built Empore C18 StageTips (3M, 2315) as described previously (Rappsilber et al., 2007). Sample loading, washes, and elution were performed on a tabletop centrifuge at a maximum speed of 2,000-3,500×g. Briefly, StageTips were equilibrated with 2×100 µL washes of methanol, 2×50 µL washes of 50% acetonitrile/0.1% formic acid (FA), and 2×100 µL washes of 1% FA. In a tube, the dried beads from MHC-associated peptide IPs were thawed at 4° C., reconstituted in 50 µL 3% ACN/5% FA, and loaded onto StageTips. The beads were washed with 50 µL 1% FA, and peptides were further eluted using two rounds of 5-minute incubations in 10% acetic acid. The combined wash and elution volumes were combined and loaded onto StageTips. The tubes containing the IP beads were washed again with 50 µL 1% FA, and this volume was also loaded onto StageTips. Peptides were washed twice on the StageTip with 100 µL 1% FA. Peptides were eluted using a step gradient of 20 µL 20% ACN/0.1% FA, 20 µL 40% ACN/0.1% FA, and 20 µL 60% ACN/0.1% FA. Step elutions were combined and dried to completion.

iTRAQ 4-plex labeling for quantitative proteomics. Quantitative proteomics was performed as described previously (Lassen et al., 2014; Mertins et al., 2014). Briefly, each peptide mixture was reconstituted in 20 µL dissolution buffer labeled with 0.5 units (40 µL of 80 µL iTRAQ4 reagent in ethanol) of iTRAQ 4 reagent for 1 hour at room temperature (RT) (~22° C.). Excess reagent was quenched with 5 µL Tris/HCl for 30 minutes at RT. iTRAQ4-plexes were combined, dried to completion, and acidified by adding 1% FA (150 µL). Samples were desalted on in-house built Empore SCX/C18 StageTips (3M, 2315, 2251) as described previously (Rappsilber et al., 2007). Peptides were eluted from the C18/SCX StageTips with two pH cuts (5.5, 11), and the remaining 20% ACN was diluted with 1% FA. Samples were then loaded on in-house built Empore C18 StageTips, desalted, and dried to completion as described above.

MHC-peptide sequencing by tandem mass spectrometry. All nanoLC-ESI-MS/MS analyses employed the same LC separation conditions described below. Samples were chromatographically separated using a Proxeon Easy NanoLC 1000 (Thermo Scientific, San Jose, CA) fitted with a PicoFrit (New Objective, Woburn, MA) 75-µm inner diameter capillary with a 10-µm emitter was packed under pressure to ~20 cm with of C18 Reprosil beads (1.9 µm particle size, 200 Å pore size, Dr. Maisch GmBH) and heated at 50° C. during separation. Samples were reconstituted in 9 µL 3% ACN/5% FA, and 3 µL (~100×10$^6$ cell equivalents) was injected for analysis. Peptides were eluted with a linear gradient from 7-30% of Buffer B (0.1% FA/90% ACN) over 82 min, 30-90% Buffer B over 6 min, and then held at 90% Buffer B for 15 min at 200 nL/min (Buffer A: 0.1% FA/3% ACN) to yield ~11 sec peak widths. During data-dependent acquisition, eluted peptides were introduced into a Q-Exactive HF mass spectrometer (Thermo Scientific) equipped with a nanoelectrospray source (James A. Hill Instrument Services, Arlington, MA) at 2.15 kV. A full-scan MS was acquired at a resolution of 60,000 from 300 to 1,800 m/z (AGC target 16, 20 ms Max IT). Each full scan was followed by top 15 data-dependent MS2 scans at resolution 15,000, using an isolation width of 1.7 m/z with a 0.3 m/z offset, a fixed first mass at 100 m/z, a collision energy of 29, an ACG Target of 5e4, and a max fill time of 100 ms max injection time. An isolation offset of 0.3 m/z was used so that doubly charged precursor isotope distributions would be centered in the isolation window. Some MHC-associated peptides tend to be short (<15 amino acids) so the monoisotopic peak is nearly always the tallest peak in the isotope cluster and the mass spectrometer acquisition software places the tallest isotopic peak in the center of the isolation window in the absence of a specified offset. Dynamic exclusion was enabled with a repeat count of 1 and an exclusion duration of 10 sec. Charge state screening was enabled along with monoisotopic precursor selection using Peptide Match Preferred to prevent triggering of MS/MS on precursor ions with charge state 1, >6, or unassigned.

Interpretation of MS/MS data. Mass spectra were interpreted using the Spectrum Mill software package v5.1 pre-Release (Agilent Technologies). MS/MS spectra were excluded from searching if they did not have a precursor MH+ in the range of 600-4000, had a precursor charge >5, or had a minimum of <5 detected peaks. Merging of similar spectra with the same precursor m/z acquired in the same chromatographic peak was disabled. High resolution MS/MS spectra were searched against a UniProt database containing reference proteome sequences (including isoforms and excluding fragments) from human mouse (41,157 entries) with a set of common laboratory contaminant proteins (150 sequences) to yield a total of 41,307 redundant sequences. The sequences were downloaded from the UniProt website in April 2013.

Prior to both search rounds all MS/MS had to pass the spectral quality filter with a sequence tag length >3, i.e., minimum of 4 masses separated by the in-chain mass of an amino acid. In the first round search, all spectra were searched using a no-enzyme specificity, fixed modification of cysteine as unmodified, fixed modification of partial iTRAQ labeling, the following variable modifications (oxidized methionine, deamidation, acetyl-N-term), a precursor mass tolerance of ±10 ppm, product mass tolerance of ±20 ppm, and a minimum matched peak intensity of 50%. Peptide spectrum matches (PSMs) for individual spectra were automatically designated as confidently assigned using the Spectrum Mill autovalidation module to apply target-decoy based FDR estimation at the PSM level to set scoring threshold criteria. Peptide autovalidation was performed with an auto thresholds strategy using a minimum sequence length of 7, automatic variable range precursor mass filtering, and score and delta Rank1-Rank2 score thresholds optimized across all LC-MS/MS runs. This yielded a PSM level FDR estimate for precursor charges 1 thru 7 of <1.0% for each precursor charge state. In the second round search, all remaining spectra that were not confidently identified in the first round were searched using the above parameters against a RefSeq database containing *L. monocytogenes* EGD-e reference protein sequences (2,867) downloaded in December 2014. An additional round of FDR thresholding as described above was applied to PSMs from the second round search to estimate FDR by species (mouse vs. *L. monocytogenes* EGD-e). The combined PSMs from each round had a peptide level FDR<2.0%. Only *L. monocytogenes* EGD-e peptides that did not overlap with human peptides were reported.

*Listeria* infection and ELISPOT. *L. monocytogenes* strain EGDe (ATCC BA-679) was grown to log phase in BHI, washed in PBS, and used to inoculate mice by i.p. injection with a dose of $1\times10^4$ CFU/200 µl/mouse. Seven days after infection, spleens were harvested, red blood cells were lysed, and single cell suspensions were replated at $2.5\times10^5$/200 µl/well on 96-well ELISPOT plates (Millipore MAIPS4510) precoated with anti-IFNγ (BD Pharmingen 551881) at a concentration of 5 µg/ml in PBS. Peptides were added at a concentration of 100 nM to restimulate splenocytes overnight. After stimulation, plates were washed, blocked, and incubated with biotinylated anti-IFNγ (BD Pharmingen 551881) at a concentration of 2 µg/ml and streptavidin-AKP (BD Pharmingen 554065) at a dilution of 1:1000. After 60 minutes, plates were washed and developed with 3-amino-9-ethylcarbazole (AEC, Sigma-Aldrich, A6926). IFNγ-secreting cells were scanned and enumerated using an Immunospot Analyzer ELISpot reader (CTL). All samples were run in triplicate. The following peptides were synthesized by New England Peptide: lmo2185_293-312 ADFRYVFDTAKATAASSYPG (SEQ ID NO: 14986), lmo0202_189-204 WNEKYAQAYPNVSAKI (SEQ ID NO: 14981), lmo0135_150-169 VDDTTVKFTLPTVAPAFENT (SEQ ID NO: 14997), lmo2558_533-553 APGQETQHYYGLPVADSAIDR (SEQ ID NO: 14984), lmo2360_289-306 GGINQAYTGSTALSDGLN (SEQ ID NO: 15009), lmo0186_285-303 GTKEKVVATPVSNVSTSSA (SEQ ID NO: 15005), lmo0582a_26-46 STVVVEAGDTLWGIAQSKGTT (SEQ ID NO: 15012), lmo0582b_12-25 IAVTAFAAPTIASA (SEQ ID NO: 15013). To calculate the frequency of CD4+ cells in each splenocyte sample from infected mice, an aliquot of cells from each mouse was stained for flow cytometric analysis. $1\times10^6$ cells were incubated with 2.4G2 Mouse Fc block in PBS/FBS (BD Pharmingen, 553142) for 20 min at 4° C. Cells were then washed and stained with FITC-conjugated anti-mouse CD4 (Biolegend, 100510) for 20 min at 4° C. Fluorescently labeled cells were acquired on the FACSVerse flow cytometer (BD Biosciences) and analyzed using FlowJo Analysis Software (Tree Star).

BOTA algorithm architecture. BOTA starts with an input genome and the associated genome annotation. The genome annotation may be in GFF3 format. It first extracts the amino acid sequences of the protein-coding genes and then performs the following analysis: (i) domain identification using hmmscan of HMMER3.1b2 (Eddy, 2011) against (Finn et al., 2016); (ii) cellular localization prediction using PSORTb v3.0.2 (Yu et al., 2010) with default settings; and (iii) transmembrane topology prediction by HMMTOP (Tusnady and Simon, 1998). This information is then integrated to generate a list of candidate peptides following three criteria: (i) the protein should be located in the outer membrane, cell wall (if applicable), or extracellular space; (ii) if located in the outer membrane or cell wall, only the outfacing part of the protein will be considered; and (iii) the peptide should present sufficient accessibility as decided by three rules: (iii-a) it cannot be fewer than eight amino acids away from anchoring domain in the cell wall or outer membrane; (iii-b) it cannot be located in domains shorter than 30 amino acids due to the fact that small domains are usually tightly folded; and (iii-c) it cannot be flanked by two domains that are fewer than 20 amino acids apart. These candidate peptides are then scored by the deep neural network as described below. For each peptide classified as a candidate epitope, BOTA further validates it with the motif score as defined previously, and a randomized score. For the motif score validation, it calculates all the 9-mers within the peptide and requires the maximum to be larger than $5\times10^{-11}$; for the randomized score, BOTA shuffles the amino acids in the 9-mer and calculates the motif score for each of the randomized 9-mers. The original 9-mer's motif score requires a rank in the top 30% of all randomized 9-mers.

In certain example embodiments, protein intracellular prediction may be achieved by using a lowest common ancestor (LCA) database to train a convolutional neural network (CNN) model, a generative adversarial network (GAN) models, or both. In other example embodiments, multiple transmembranal databases may be used to train a domain prediction model for use in conjunction with, or as an alternative to HMMTOP.

Deep neural network for MHCII binder prediction. Applicants employed a deep neural network scheme to develop an MHCII-binder predictor. In brief, Applicants first encoded every amino acid into a p-dimensional binary vector b, with half of its elements being 1 and the rest being 0, chosen at random. Therefore, given a peptide with length l longer than k, it is first converted to an l×b descriptor matrix S, in which $S_{ij}=1$ if the i-th amino acid's 1-valued indices overlap with j, otherwise $S_{ij}=0$. The matrix S is then normalized by row sum to become S' such that $$S_{ij}' = S_{ij}/\Sigma_{j=1}^{b} S_{ij}$$

S' is then convoluted into an (l−k+1)×d matrix X, where d is the number of pre-trained motif network models within the overall model and k is the length of such binding cores. $X_{ij}$ represents the score of motif network model j aligned to position i. The cohort of motif network models are arranged in a d×k×b array H with $H_{ijk}$ being the d-th motif network model aligned to the k-th position of the b-th set of amino acids (FIG. 8D). This sequence conversion and convolution setup is similar to model developed by Alipanahi et al (Alipanahi et al., 2015).

With the convoluted matrix X, Applicants filter it with a max-rectified linear unit (ReLU) layer, and the rectified matrix Y is then fed into a max pooling stage to be transformed into d-dimensional vector Z, in which $$z_j = \max(Y_{1j}, Y_{2j}, \ldots, Y_{nj})$$

This d-dimensional vector Z is then used as input for a neural network with Maxout dropout model. Z is then used as the input for a standard output layer for final prediction calculation.

The goal is to minimize the prediction error as measured by 1-norm distance of all the peptides. Back propagation with a stochastic gradient descent method using mini batch size at 64 was used to reach optimal weights. To train the weights, the mouse epitope peptides were used as training set true positive; Applicants also added in silico true negative peptides by surveying an equal number of the peptides that are not part of the peptidomics data readout at random. Applicants first randomly constructed 100 replicates of 3-fold cross validation datasets using the epitopes and the in silico true negative sequences. For each replicate, BOTA's initial state weights were assigned randomly and then trained until performance plateaued (<0.1% improvement in ten iterations). The validation's average AUC was used as a measure of model fitness; and the one with the highest average AUC among the 100 replicates was chosen to generate the final optimal parameters by using all mouse peptides (FIG. 9C). Then the optimal model constructed from the previous step were used to predict the unique *Listeria* peptides, and netMHCIIpan was used to predict the affinity of the same set of peptides with default settings.

TCRseq and 5' digital gene expression (DGE). 5'DGE RNA-seq data were analyzed using an in-house data analysis pipeline. Reads were aligned to the mm10 genome using bwa (Li et al., 2009). The downstream analysis was carried out using the Seurat package (www.satijalab.org/seurat). The dataset was filtered to remove genes that were expressed in less than 10% of the data or cells that expressed transcripts that mapped to fewer than 500 unique genes. Further, to remove doublet cells, cells that displayed more heterogeneity than the $90^{th}$ quantile (1846 unique genes) were filtered out. Highly variable, highly expressed genes (log $(\sigma/\mu)>0.75$ and log $(\mu)>1.5$) were identified from a mean-variance dispersion analysis. These genes were then used for clustering the single cells using the SNN-Cliq algorithm, which maps the cells onto a k-nearest neighbor graph and then finds "cliques" of cells expressing similar genes (McDavid et al., 2014; Xu and Su, 2015). It was found that cells expressing Ifng and Tbx21 belonged primarily to cluster 0. Cluster identities of Th17 single cells were overlaid on a t-SNE plots. The cells were clustered on the basis of highly expressed, highly varying genes, using a graph-based method, SNN-Cliq (McDavid et al., 2014). Violin/Feature plot: Ifng is identified as a marker gene for cluster 0 based on the bimod test for differential expression (Xu et al., 2015).

TCR Screening. TCR-negative BW5147 cells were obtained from ATCC. The stable sub-line BW_4-28 was produced by introduction of murine CD4 and CD28 by lentiviral transduction. The Orf encoding CD4-P2A-CD28 was synthesized (IDT) and cloned in place of spCas9-P2A-BlastR into pXPR_BRD101 (Genetic Perturbation Platform, Broad Institute) by Gibson assembly. The stable sub-line BW_B7/4 was produced by introduction of chimeric murine CD86 cytoplasmic domain fused in-frame with CD4 transmembrane and cytoplasmic domains by lentiviral transduction. The Orf encoding CD86/CD4 was synthesized (IDT) and cloned in place of spCas9-P2A-BlastR into pXPR_BRD101 (Genetic Perturbation Platform, Broad Institute) by Gibson assembly.

scTCRz_v3 vector was derived from pLX_TRC307 (Genetic Perturbation Platform, Broad Institute) by replacing the stuffer sequence with the following codon-optimized Orf: mTrbc1-hCD3zeta (transmembrane and cytoplasmic domains)-P2A-hIgKleader-mTrac hCD3zeta (transmembrane and cytoplasmic domains). Single-chain TCRs were synthesized as gBlocks (IDT) comprising Trav-Traj-linker (3×G$_4$SGGGG)-Trbv-Trbj and cloned by Gibson assembly into NheI and BsrGI sites upstream of Trbc1 in scTCRz_v3 vector. MHCIIz_v2 vector was derived from pLX_TRC307 (Genetic Perturbation Platform, Broad Institute) by replacing the stuffer sequence with the following sequence: H2Ab1leader-XmaI-linker (3×G$_4$S)-H2Ab1 (extracellular and transmembrane domains)-hCD3zeta (cytoplasmic domain)-P2A H2Aa (extracellular and transmembrane domains)-hCD3zeta (cytoplasmic domain). Peptide epitope-encoding sequences were synthesized as ultramers (IDT) and cloned by Gibson assembly into the XmaI site in the MHCIIz_v2 vector. pMHCII and scTCRs were introduced into BW_B7/4 and BW_4-28 cells, respectively, by lentiviral transduction and maintained under puromycin selection (3 ug/ml). To define antigen specificity of TCRs, BW_4-28 cells expressing scTCRs were cocultured with HEK 293T cells transfected with pMHCII and CD86/CD4 or BW_B7/4 cells expressing pMHCII. Cells were combined at a 1:1 ratio in 96-well flat-bottom plates (total 100,000 cells/well). Culture supernatants were harvested after 18 hours, and IL-2 was measured by cytokine bead array (BD Pharmingen) or cells were harvested after 18 hours, and mRNA expression of the activation marker Nur77 (Nr4a1) was quantified relative to Actb.

Animals. Mice were bred in specific-pathogen-free facilities at Massachusetts General Hospital (Boston, MA) prior to infection and transferred to biosafety level 2 (BL2) housing upon *L. monocytogenes* infection. All animal studies were conducted in compliance with ethical regulations and were approved by the Institutional Care and Use Committee (IACUC) at Massachusetts General Hospital. Atg5$^{f/f}$ and Atg16l1$^{f/f}$ mice were generated as previously described (Conway et al., 2013b; Hara et al., 2006) and bred with mice expressing Cre recombinase under the control of the CD11c promoter (CD11c-Cre) (Jackson Laboratories). All mice were maintained on food and water ad libitum, used between 8-12 weeks of age, and age- and sex-matched for each experiment.

Statistical analysis. For data analysis, iTRAQ 4 ratios for the two biological replicates were filtered to retain only those deemed reproducible as described previously (Kronke et al., 2015). Reproducibility was based on replicates being confined within the 95% limits of agreement of a Bland-Altman plot (Bland and Altman, 1986). Reproducible replicates were then subjected to a moderated t-test to assess statistical significance (Smyth, 2004). To generate the I-A$^b$-binding motif, all mouse peptides were aligned by MultAlin (Corpet, 1988) and visualized with WebLogo (Crooks et al., 2004). The frequencies of each amino acid at each position of the 9-mer core were used to generate a position-weight matrix. I-A$^b$ binding scores for *Listeria* peptides were produced from this matrix and represented as the product of amino acid frequencies for each position of the 9-mer core (Table 1). Epitope mapping and protein domain overlay were performed with NCBI's Conserved Domain Database (Marchler-Bauer et al., 2015). Subcellular localization of antigenic *Listeria* proteins was predicted by PSORTb v3.0.2 (Yu et al., 2010), and by COMPARTMENTS (Binder et al., 2014) for mouse proteins. Transmembrane topology was predicted with HMMTOP (Tusnady and Simon, 1998).

REFERENCES

Alipanahi, B., Delong, A., Weirauch, M. T., and Frey, B. J. (2015). Predicting the sequence specificities of DNA- and RNA-binding proteins by deep learning. Nat Biotechnol 33, 831-838.

Anders, S., Pyl, P. T., and Huber, W. (2015). HTSeq$^{-/-}$ a Python framework to work with high-throughput sequencing data. Bioinformatics 31, 166-169.

Andreatta, M., Schafer-Nielsen, C., Lund, O., Buus, S., and Nielsen, M. (2011). NNAlign: a web-based prediction method allowing non-expert end-user discovery of sequence motifs in quantitative peptide data. PLOS ONE 6, e26781.

Arunachalam, B., Phan, U. T., Geuze, H. J., and Cresswell, P. (2000). Enzymatic reduction of disulfide bonds in lysosomes: characterization of a gamma-interferon-inducible lysosomal thiol reductase (GILT). Proc Natl Acad Sci USA 97, 745-750.

Babbitt, B. P., Allen, P. M., Matsueda, G., Haber, E., and Unanue, E. R. (1985). Binding of immunogenic peptides to Ia histocompatibility molecules. Nature 317, 359-361.

Binder, J. X., Pletscher-Frankild, S., Tsafou, K., Stolte, C., O'Donoghue, S. I., Schneider, R., and Jensen, L. J. (2014). COMPARTMENTS: unification and visualization of protein subcellular localization evidence. Database (Oxford) 2014, bau012.

Bland, J. M., and Altman, D. G. (1986). Statistical methods for assessing agreement between two methods of clinical measurement. Lancet 1, 307-310.

Chatterjee, S. S., Hossain, H., Otten, S., Kuenne, C., Kuchmina, K., Machata, S., Domann, E., Chakraborty, T., and Hain, T. (2006). Intracellular gene expression profile of *Listeria monocytogenes*. Infect Immun 74, 1323-1338.

Chicz, R. M., Urban, R. G., Gorga, J. C., Vignali, D. A., Lane, W. S., and Strominger, J. L. (1993). Specificity and promiscuity among naturally processed peptides bound to HLA-DR alleles. J Exp Med 178, 27-47.

Chicz, R. M., Urban, R. G., Lane, W. S., Gorga, J. C., Stern, L. J., Vignali, D. A., and Strominger, J. L. (1992). Predominant naturally processed peptides bound to HLA-DR1 are derived from MHC-related molecules and are heterogeneous in size. Nature 358, 764-768.

Christmann, B. S., et al. Human seroreactivity to gut microbiota antigens. J. Allergy Clin. Immunol. 136, 1378-1386 e1371-1375 (2015).

Conway, K. L., Kuballa, P., Song, J. H., Patel, K. K., Castoreno, A. B., Yilmaz, O. H., Jijon, H. B., Zhang, M., Aldrich, L. N., Villablanca, E. J., et al. (2013a). Atg16l1 is required for autophagy in intestinal epithelial cells and protection of mice from *Salmonella* infection. Gastroenterology 145, 1347-1357.

Conway, K. L., Kuballa, P., Khor, B., Zhang, M., Shi, H. N., Virgin, H. W., and Xavier, R. J. (2013b). ATG5 regulates plasma cell differentiation. Autophagy 9, 528-537.

Corpet, F. (1988). Multiple sequence alignment with hierarchical clustering. Nucleic Acids Res 16, 10881-10890.

Cresswell, P., Arunachalam, B., Bangia, N., Dick, T., Diedrich, G., Hughes, E., and Maric, M. (1999). Thiol oxidation and reduction in MHC-restricted antigen processing and presentation. Immunol Res 19, 191-200.

Crooks, G. E., Hon, G., Chandonia, J. M., and Brenner, S. E. (2004). WebLogo: a sequence logo generator. Genome Res 14, 1188-1190.

Depontieu, F. R., Qian, J., Zarling, A. L., McMiller, T. L., Salay, T. M., Norris, A., English, A. M., Shabanowitz, J., Engelhard, V. H., Hunt, D. F., et al. (2009). Identification of tumor-associated, MHC class II-restricted phosphopeptides as targets for immunotherapy. Proc Natl Acad Sci USA 106, 12073-12078.

Dongre, A. R., et al. In vivo MHC class II presentation of cytosolic proteins revealed by rapid automated tandem mass spectrometry and functional analyses. Eur. J. Immunol. 31, 1485-1494 (2001).

Eddy, S. R. (2011). Accelerated Profile HMM Searches. PLOS Comput Biol 7, e1002195.

Finn, R. D., Coggill, P., Eberhardt, R. Y., Eddy, S. R., Mistry, J., Mitchell, A. L., Potter, S. C., Punta, M., Qureshi, M., Sangrador-Vegas, A., et al. (2016). The Pfam protein families database: towards a more sustainable future. Nucleic Acids Res 44, D279-285.

Hall, A. B., Tolonen, A. C. & Xavier, R. J. Human genetic variation and the gut microbiome in disease. Nat. Rev. Genet. 18, 690-699 (2017).

Hara, T., Nakamura, K., Matsui, M., Yamamoto, A., Nakahara, Y., Suzuki-Migishima, R., Yokoyama, M., Mishima, K., Saito, I., Okano, H., et al. (2006). Suppression of basal autophagy in neural cells causes neurodegenerative disease in mice. Nature 441, 885-889.

Heng, T. S., Painter, M. W. & Immunological Genome Project, C. The Immunological Genome Project: networks of gene expression in immune cells. Nat. Immunol. 9, 1091-1094 (2008).

Hsieh, C. S., deRoos, P., Honey, K., Beers, C., and Rudensky, A. Y. (2002). A role for cathepsin L and cathepsin S in peptide generation for MHC class II presentation. J Immunol 168, 2618-2625.

Hsing, L. C., and Rudensky, A. Y. (2005). The lysosomal cysteine proteases in MHC class II antigen presentation. Immunol Rev 207, 229-241.

Hunt, D. F., Michel, H., Dickinson, T. A., Shabanowitz, J., Cox, A. L., Sakaguchi, K., Appella, E., Grey, H. M., and Sette, A. (1992). Peptides presented to the immune system by the murine class II major histocompatibility complex molecule I-Ad. Science 256, 1817-1820.

Janeway, C. A., Jr., Conrad, P. J., Lerner, E. A., Babich, J., Wettstein, P., and Murphy, D. B. (1984). Monoclonal antibodies specific for Ia glycoproteins raised by immunization with activated T cells: possible role of T cell-bound Ia antigens as targets of immunoregulatory T cells. J Immunol 132, 662-667.

Kim, A., and Sadegh-Nasseri, S. (2015). Determinants of immunodominance for CD4 T cells. Curr Opin Immunol 34, 9-15.

Kim, D., Pertea, G., Trapnell, C., Pimentel, H., Kelley, R., and Salzberg, S. L. (2013). TopHat2: accurate alignment of transcriptomes in the presence of insertions, deletions and gene fusions. Genome Biol 14, R36.

Kronke, J., Fink, E. C., Hollenbach, P. W., MacBeth, K. J., Hurst, S. N., Udeshi, N. D., Chamberlain, P. P., Mani, D. R., Man, H. W., Gandhi, A. K., et al. (2015). Lenalidomide induces ubiquitination and degradation of CK1alpha in del(5q) MDS. Nature 523, 183-188.

Lassen, K. G., Kuballa, P., Conway, K. L., Patel, K. K., Becker, C. E., Peloquin, J. M., Villablanca, E. J., Norman, J. M., Liu, T. C., Heath, R. J., et al. (2014). Atg16L1 T300A variant decreases selective autophagy resulting in altered cytokine signaling and decreased antibacterial defense. Proc Natl Acad Sci USA 111, 7741-7746.

Li, H. & Durbin, R. Fast and accurate short read alignment with Burrows-Wheeler transform. Bioinformatics 25, 1754-1760 (2009).

Lippolis, J. D., White, F. M., Marto, J. A., Luckey, C. J., Bullock, T. N., Shabanowitz, J., Hunt, D. F., and Engelhard, V. H. (2002). Analysis of MHC class II antigen processing by quantitation of peptides that constitute nested sets. J Immunol 169, 5089-5097.

Liu, X., et al. Alternate interactions define the binding of peptides to the MHC molecule IA(b). Proc. Natl. Acad. Sci. U.S.A. 99, 8820-8825 (2002).

Marchler-Bauer, A., Derbyshire, M. K., Gonzales, N. R., Lu, S., Chitsaz, F., Geer, L. Y., Geer, R. C., He, J., Gwadz, M., Hurwitz, D. I., et al. (2015). CDD: NCBI's conserved domain database. Nucleic Acids Res 43, D222-226.

McDavid, A., et al. Modeling bi-modality improves characterization of cell cycle on gene expression in single cells. PLOS Comput. Biol. 10, e1003696 (2014).

Mertins, P., Yang, F., Liu, T., Mani, D. R., Petyuk, V. A., Gillette, M. A., Clauser, K. R., Qiao, J. W., Gritsenko, M. A., Moore, R. J., et al. (2014). Ischemia in tumors induces early and sustained phosphorylation changes in stress kinase pathways but does not affect global protein levels. Mol Cell Proteomics 13, 1690-1704.

Miyazaki, T., Wolf, P., Tourne, S., Waltzinger, C., Dierich, A., Barois, N., Ploegh, H., Benoist, C., and Mathis, D. (1996). Mice lacking H2-M complexes, enigmatic elements of the MHC class II peptide-loading pathway. Cell 84, 531-541.

Mommen, G. P., Marino, F., Meiring, H. D., Poelen, M. C., van Gaans-van den Brink, J. A., Mohammed, S., Heck, A. J., and van Els, C. A. (2016). Sampling From the Proteome to the Human Leukocyte Antigen-DR (HLA-DR) Ligandome Proceeds Via High Specificity. Mol Cell Proteomics 15, 1412-1423.

Nelson, C. A., Roof, R. W., McCourt, D. W., and Unanue, E. R. (1992). Identification of the naturally processed form of hen egg white lysozyme bound to the murine major histocompatibility complex class II molecule I-Ak. Proc Natl Acad Sci USA 89, 7380-7383.

Ormerod, K. L., et al. Genomic characterization of the 1 uncultured Bacteroidales family S24-7 inhabiting the guts of homeothermic animals. Microbiome 4, 36 (2016).

Palm, N. W., de Zoete, M. R. & Flavell, R. A. Immune-microbiota interactions in health and disease. Clin. Immunol. 159, 122-127 (2015).

Rappsilber, J., Mann, M., and Ishihama, Y. (2007). Protocol for micro-purification, enrichment, pre-fractionation and storage of peptides for proteomics using StageTips. Nat Protoc 2, 1896-1906.

Robinson, M. D., McCarthy, D. J., and Smyth, G. K. (2010). edgeR: a Bioconductor package for differential expression analysis of digital gene expression data. Bioinformatics 26, 139-140.

Rudensky, A., Preston-Hurlburt, P., Hong, S. C., Barlow, A., and Janeway, C. A., Jr. (1991). Sequence analysis of peptides bound to MHC class II molecules. Nature 353, 622-627.

Scallan, E., Hoekstra, R. M., Angulo, F. J., Tauxe, R. V., Widdowson, M. A., Roy, S. L., Jones, J. L., and Griffin, P. M. (2011). Foodborne illness acquired in the United States—major pathogens. Emerg Infect Dis 17, 7-15.

Schindelin, J., Arganda-Carreras, I., Frise, E., Kaynig, V., Longair, M., Pietzsch, T., Preibisch, S., Rueden, C., Saalfeld, S., Schmid, B., et al. (2012). Fiji: an open-source platform for biological-image analysis. Nat Methods 9, 676-682.

Schulze, M. S., and Wucherpfennig, K. W. (2012). The mechanism of HLA-DM induced peptide exchange in the MHC class II antigen presentation pathway. Curr Opin Immunol 24, 105-111.

Seamons, A., Sutton, J., Bai, D., Baird, E., Bonn, N., Kafsack, B. F., Shabanowitz, J., Hunt, D. F., Beeson, C., and Goverman, J. (2003). Competition between two MHC binding registers in a single peptide processed from myelin basic protein influences tolerance and susceptibility to autoimmunity. J Exp Med 197, 1391-1397.

Sette, A., Ceman, S., Kubo, R. T., Sakaguchi, K., Appella, E., Hunt, D. F., Davis, T. A., Michel, H., Shabanowitz, J., Rudersdorf, R., et al. (1992). Invariant chain peptides in most HLA-DR molecules of an antigen-processing mutant. Science 258, 1801-1804.

Smyth, G. K. (2004). Linear models and empirical bayes methods for assessing differential expression in microarray experiments. Stat Appl Genet Mol Biol 3, Article3.

Sofron, A., Ritz, D., Neri, D., and Fugmann, T. (2016). High-resolution analysis of the murine MHC class II immunopeptidome. Eur J Immunol 46, 319-328.

Stern, L. J., Brown, J. H., Jardetzky, T. S., Gorga, J. C., Urban, R. G., Strominger, J. L., and Wiley, D. C. (1994). Crystal structure of the human class II MHC protein HLA-DR1 complexed with an influenza virus peptide. Nature 368, 215-221.

Stoll, M. L., et al. Altered microbiota associated with abnormal humoral immune responses to commensal organisms in enthesitis-related arthritis. Arthritis Res. Ther. 16, 486 (2014).

Suri, A., Walters, J. J., Rohrs, H. W., Gross, M. L., and Unanue, E. R. (2008). First signature of islet beta-cell-derived naturally processed peptides selected by diabetogenic class II MHC molecules. J Immunol 180, 3849-3856.

Tusnady, G. E., and Simon, I. (1998). Principles governing amino acid composition of integral membrane proteins: application to topology prediction. J Mol Biol 283, 489-506.

Wang, P., Sidney, J., Dow, C., Mothe, B., Sette, A., and Peters, B. (2008). A systematic assessment of MHC class II peptide binding predictions and evaluation of a consensus approach. PLOS Comput Biol 4, e1000048.

Weber, K. S., et al. Distinct CD4+ helper T cells involved in primary and secondary responses to infection. Proc. Natl. Acad. Sci. U.S.A. 109, 9511-9516 (2012).

Xu, C. & Su, Z. Identification of cell types from single-cell transcriptomes using a novel clustering method. Bioinformatics 31, 1974-1980 (2015).

Yu, N. Y., Wagner, J. R., Laird, M. R., Melli, G., Rey, S., Lo, R., Dao, P., Sahinalp, S. C., Ester, M., Foster, L. J., et al. (2010). PSORTb 3.0: improved protein subcellular localization prediction with refined localization subcategories and predictive capabilities for all prokaryotes. Bioinformatics 26, 1608-1615.

Zeng, M. Y., et al. Gut Microbiota-Induced Immunoglobulin G Controls Systemic Infection by Symbiotic Bacteria and Pathogens. Immunity 44, 647-658 (2016).

Zhu, Y., Rudensky, A. Y., Corper, A. L., Teyton, L. & Wilson, I. A. Crystal structure of MHC class II I-Ab in complex with a human CLIP peptide: prediction of an I-Ab peptide-binding motif. J. Mol. Biol. 326, 1157-1174 (2003).

The invention is further described by the following numbered paragraphs:

1. A method for identifying MHCII antigenic epitopes comprising:
   generating, by a processor, a set of candidate antigens from one or more input genome sequences; and
   generating, by the processor, a ranked set of antigenic epitopes from the candidate antigens using a deep neural network, wherein the deep neural network is trained using a set of MHCII-presented peptides isolated from antigen presenting cells.
2. The method of paragraph 1, wherein the antigen presenting cells are dendritic cells.
3. The method of paragraph 1, wherein generating a set of candidate antigens from one or more input genome sequences comprises:
   predicting, by the processor, genes from an input genome sequence; and
   defining, by the processor, a set of candidate antigens from the set of predicted genes based on one or more of protein cellular location, transmembrane structure, and domain distribution.
4. The method of paragraph 3, wherein defining, by the processor, a set of candidate antigens from the set of predicted genes, comprises:
   a) selecting surface and secreted proteins;
   b) masking intracellular regions and transmembrane domains of the surface and extracellular proteins;
   c) excluding regions that are within domains of less than 30 amino acids;
   d) excluding regions between a series of inaccessible domains; and
   e) excluding inter-domain regions between a series of adjacent domains wherein the inter-domain regions are less than or equal to 20 amino acids.
5. The method of paragraph 4, further comprising masking up to 20 amino acids flanking the intracellular regions and transmembrane domains.
6. The method of paragraph 4, wherein 8 amino acids flanking the intracellular regions and transmembrane domains are masked.
7. The method of paragraph 4, wherein the surface protein is a cell wall protein.
8. The method of paragraph 4, wherein the surface protein is an outer membrane protein.
9. The method of any of paragraphs 1 to 8, wherein the antigenic epitopes are derived from candidate antigens more than 20 amino acids away from a transmembrane domain.
10. The method of any of paragraphs 1 to 9, wherein the candidate antigens comprise a tertiary structure required for proteolytic enzyme accessibility.
11. The method of any of paragraphs 1 to 10, wherein the candidate antigens comprise a defined MHCII-binding motif in the primary amino acid sequence of the predicted genes.
12. The method of paragraph 11, wherein the defined MHCII-binding motif is the I-A$^b$-binding motif.
13. The method of any of paragraphs 1 to 12, wherein the antigenic epitopes comprise a tertiary structure required for accessibility to a MHCII binding groove.
14. The method of any of paragraphs 1 to 13, wherein generating, by the processor, a ranked set of antigenic epitopes from the candidate antigens using a deep neural network comprises:
   a) encoding each amino acid of an input candidate antigen into a p-dimensional binary vector;
   b) converting the binary vector to a descriptor matrix S;
   c) convoluting the descriptor matrix S to a scoring matrix X; and
   d) transforming the scoring matrix X into a d-dimensional vector Z, wherein vector Z is input for a neural network.
15. The method of any of paragraphs 1 to 14, wherein the method further comprises:
   isolating MHCII-peptide complexes from antigen presenting cells;
   isolating the peptides from the MHCII-peptide complexes;
   sequencing the isolated peptides; and
   training the deep neural network using the set of isolated peptides.
16. The method of paragraph 15, wherein the antigen presenting cells are exposed to a target cell type or target pathogen.
17. The method of paragraph 15 or 16, wherein the antigen presenting cells are dendritic cells.
18. The method of any of paragraphs 1 to 17, wherein the input genome sequence is derived from a target cell type or target pathogen.
19. The method of paragraph 18, wherein the candidate antigens are expressed in the target cell type or target pathogen.
20. The method of any of paragraph 16 to 19, wherein the target cell type or target pathogen is selected from the group consisting of a bacterium, a virus, a protozoa, an allergen and a diseased cell.
21. The method of paragraph 20, wherein the diseased cell is a cancer cell.
22. The method of paragraph 21, wherein the cancer cell is obtained from a subject.
23. The method of paragraph 22, further comprising identifying non-silent tumor specific somatic mutations from the subject specific cancer cell, wherein the ranked set of antigenic epitopes are generated from said mutations.
24. The method of paragraph 20, wherein the diseased cell is associated with an autoimmune disease.
25. The method of paragraph 20, wherein the target pathogen comprises a bacteria belonging to a family selected from the group consisting of *Bacillus, Bartonella, Bordetella, Borrelia, Brucella, Campylobacter, Chlamydia* and *Chlamydophila, Clostridium, Corynebacterium, Enterococcus, Escherichia, Francisella, Haemophilus, Helicobacter, Legionella, Leptospira, Listeria, Mycobacterium, Mycoplasma, Neisseria, Pseudomonas, Rickettsia, Salmonella, Shigella, Staphylococcus, Streptococcus, Treponema, Ureaplasma, Vibrio,* and *Yersinia.*

26. The method of any of paragraphs 1 to 25, wherein the antigen presenting cell comprises a subject specific MHCII allele.
27. The method of any of paragraphs 1 to 26, wherein the antigen presenting cell comprises a human MHCII allele.
28. The method of any of paragraphs 1 to 27, wherein the one or more input genome sequences is obtained by whole genome or whole exome sequencing.
29. The method of any of paragraphs 1 to 20, further comprising detecting whether one or more the antigenic epitopes is present in a sample from a subject suffering from an infection, autoimmune disease, allergy, or cancer.
30. The method of any one of paragraphs 1 to 29, wherein the antigenic epitopes are about 9 to 20 amino acids in length.
31. The method of any of paragraphs 1 to 30, wherein the deep neural network is trained using a set of MHCII-presented peptides comprising one or more of SEQ ID NOs: 1-14979.
32. The method of any of paragraphs 1 to 31, wherein the deep neural network is trained using a set of MHCII-presented peptides comprising one or more of SEQ ID NOs: 14980-15027.
33. The method of any of paragraphs 1 to 32, further comprising preparing a vaccine composition comprising one or more antigenic epitopes from the set of antigenic epitopes generated by the processor.
34. The method of paragraph 33, wherein the vaccine composition is directed to a bacterium, a virus or a protozoa.
35. The method of paragraph 33, wherein the vaccine composition is directed to a cancer.
36. The method of paragraph 33, wherein the vaccine composition is directed to an autoimmune disease, whereby administration of the vaccine induces tolerance to the antigenic epitope.
37. The method of paragraph 34, wherein the vaccine composition is directed to *Listeria*.
38. The method of paragraph 37, wherein the vaccine composition comprises one or more *Listeria* peptides selected from the peptides listed in Table 1.
39. The method of paragraph 38, wherein the one or more *Listeria* peptides are derived from lmo0202, lmo2558, lmo2185, or lmo0135.
40. The method of paragraph 39, wherein the one or more *Listeria* peptides are selected from the group consisting of SEQ ID NO: 14981 (WNEKYAQAYPNVSAKI), SEQ ID NO: 14984 (APGQETQHYYGLPVADSAIDR), SEQ ID NO: 14986 (ADFRYVFDTAKATAASSYPG), and SEQ ID NO: 14997 (VDDTTVKFTLPTVAPAFENT).
41. The method of any of paragraphs 33 to 40, wherein the vaccine comprises autologous dendritic cells or antigen presenting cells pulsed with the one or more peptides.
42. A method of identifying immunodominant epitopes comprising:
   a) expressing in a first population of immune cells a peptide MHCII library comprising antigenic epitopes identified according to the method of any of paragraphs 1 to 32, wherein the first population of immune cells comprise a detectable reporter gene;
   b) expressing in a second population of CD4+ immune cells a TCRab library expressing TCRab pairs identified in a subject suffering from an infectious disease, autoimmunity, cancer or allergy;
   c) incubating the first population of immune cells with the second population of immune cells;
   d) sorting immune cells positive for the detectable reporter gene; and
   e) identifying peptides bound to MHCII in immune cells positive for the detectable reporter gene.
43. The method of paragraph 42, wherein the TCRab pairs are identified by single cell profiling.
44. The method of paragraphs 43, wherein TCRab pairs are determined by targeted single cell RNA-seq (TCRseq).
45. The method of paragraphs 43 or 44, wherein T cells are analyzed by RNA-seq to determine single cells that are activated and TCRab pairs are identified in the activated T cells.
46. The method of any of paragraphs 42 to 45, wherein the reporter is an inducible fluorescent marker protein, wherein the marker protein is induced when a TCRab pair detects a MHCII epitope.
47. The method of paragraph 46, wherein the fluorescent marker is under control of the IL-2 promoter.
48. The method of any of paragraphs 42 to 47, further comprising administering to the subject a vaccine comprising one or more of the immunodominant epitopes.
49. The method of paragraph 48, wherein the vaccine is a protective vaccine or a tolerizing vaccine.
50. The method of paragraphs 48 or 49, wherein the vaccine comprises autologous dendritic cells or antigen presenting cells pulsed with one or more of the immunodominant epitopes.
51. A method of identifying peptide antigens from a live bacterial pathogen comprising: isolating MHCII-peptide complexes from dendritic cells exposed to a bacterial pathogen; isolating the peptides from the MHCII-peptide complexes; and sequencing the isolated peptides.
52. A peptide set for training a MHCII neural network comprising one or more of SEQ ID NOs: 1-14979.
53. A peptide set for training a MHCII neural network comprising one or more of SEQ ID Nos: 14980-15027.
54. A *Listeria* vaccine comprising one or more peptides selected from the peptides listed in Table 1.
55. The *Listeria* vaccine of paragraph 42, wherein the one or more peptides is derived from lmo0202, lmo2558, lmo2185, or lmo0135.
56. The *Listeria* vaccine of paragraph 43, wherein the one or more *Listeria* peptides is selected from the group consisting of SEQ ID NO: 14981 (WNEKYAQAYPNVSAKI), SEQ ID NO: 14984 (APGQETQHYYGLPVADSAIDR), SEQ ID NO: 14986 (ADFRYVFDTAKATAASSYPG), and SEQ ID NO: 14997 (VDDTTVKFTLPTVAPAFENT).
57. The *Listeria* vaccine of any of paragraphs 42 to 44, wherein the vaccine comprises autologous dendritic cells or antigen presenting cells pulsed with the one or more peptides.

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (15234 sequences)

SEQ ID NO: 1 - protein, 9 aa, Mus sp.
VTYVPVTTF

SEQ ID NO: 2 - protein, 17 aa, Listeria monocytogenes
YPGSDETPPVVNPGETN

SEQ ID NO: 3 - protein, 19 aa, Mus sp.
IQGGDFTRGDGTGGKSIYG

SEQ ID NO: 4 - protein, 17 aa, Mus sp.
SLHLRFSAPQIENEPET

SEQ ID NO: 5 - protein, 20 aa, Listeria monocytogenes
ADFRYVFDTAKATAASSYPG

SEQ ID NO: 6 - protein, 26 aa, Listeria monocytogenes
ADFRYVFDTAKATAASSYPGSDETPP

SEQ ID NO: 7 - protein, 20 aa, Mus sp.
TEDGDMRLVNGASANEGRVE

SEQ ID NO: 8 - protein, 16 aa, Mus sp.
KKELEEQLGPVAEETR

SEQ ID NO: 9 - protein, 18 aa, Mus sp.
GTDRKIVYEGPELNHAFG

SEQ ID NO: 10 - protein, 15 aa, Mus sp.
SVASQFQMHSTPVRI

SEQ ID NO: 11 - protein, 15 aa, Mus sp.
VATNPIITPVAQENQ

SEQ ID NO: 12 - protein, 13 aa, Listeria monocytogenes
WNEKYAQAYPNVS

SEQ ID NO: 13 - protein, 17 aa, Mus sp.
SSIASFKDPKISTSLPV

SEQ ID NO: 14 - protein, 16 aa, Mus sp.
THDLYIQSHISENREE

SEQ ID NO: 15 - protein, 16 aa, Mus sp.
SVATNPIITPVAQENQ

SEQ ID NO: 16 - protein, 22 aa, Mus sp.
LDPAGPNFEYAEAPSRLSPDDA

SEQ ID NO: 17 - protein, 20 aa, Mus sp.
SGPKPFSAPKPQTSPSPKPA

SEQ ID NO: 18 - protein, 21 aa, Mus sp.
APETRSQVTPSVPSEALDDST

SEQ ID NO: 19 - protein, 15 aa, Mus sp.
QSPYINPIIPFTGPI

SEQ ID NO: 20 - protein, 22 aa, Mus sp.
IDLKGIPVYRFVLPANAFASPL

SEQ ID NO: 21 - protein, 16 aa, Listeria monocytogenes
WNEKYAQAYPNVSAKI

SEQ ID NO: 22 - protein, 23 aa, Mus sp.
VDPTPDPNTAYASYPSASVENYQ

SEQ ID NO: 23 - protein, 18 aa, Mus sp.
TPDPNTAYASYPSASVEN

SEQ ID NO: 24 - protein, 21 aa, Mus sp.
DVIIVDSGKIEVEKPFAIAKE

SEQ ID NO: 25 - protein, 21 aa, Mus sp.
YPTPAYTIPFYTPIPNGLYPS

SEQ ID NO: 26 - protein, 15 aa, Mus sp.
SGKIEVEKPFAIAKE

SEQ ID NO: 27 - protein, 19 aa, Mus sp.
SSIASFKDPKISTSLPVLD

SEQ ID NO: 28 - protein, 13 aa, Mus sp.
QLIRNGDWTFQVL

SEQ ID NO: 29 - protein, 11 aa, Mus sp.
ERFPDENFKLK

SEQ ID NO: 30 - protein, 17 aa, Mus sp.
YPTPAYTIPFYTPIPNG

SEQ ID NO: 31 - protein, 17 aa, Mus sp.
LGFPYEGPAPLEAIANG

SEQ ID NO: 32 - protein, 9 aa, Mus sp.
FLLFPDMDA

SEQ ID NO: 33 - protein, 17 aa, Mus sp.
RDGDSYRSPWSNKYDPP

SEQ ID NO: 34 - protein, 14 aa, Mus sp.
FYVDLDKKETVWML

SEQ ID NO: 35 - protein, 10 aa, Mus sp.
VEKPFAIAKE

SEQ ID NO: 36 - protein, 23 aa, Listeria monocytogenes
VETKADIDALSLLSDKIFVTNQT

SEQ ID NO: 37 - protein, 18 aa, Mus sp.
AARDNMFSGSKINYTENR

SEQ ID NO: 38 - protein, 18 aa, Mus sp.
DWQGGVYASPSIAGSRPG

SEQ ID NO: 39 - protein, 19 aa, Mus sp.
APETRSQVTPSVPSEALDD

SEQ ID NO: 40 - protein, 23 aa, Mus sp.
EIDLKGIPVYRFVLPANAFASPL

SEQ ID NO: 41 - protein, 19 aa, Mus sp.
NPLNSVFVAPAVTPVKGVL

SEQ ID NO: 42 - protein, 20 aa, Mus sp.
APETRSQVTPSVPSEALDDS

SEQ ID NO: 43 - protein, 19 aa, Mus sp.
TPAYTIPFYTPIPNGLYPS

SEQ ID NO: 44 - protein, 18 aa, Mus sp.
LTGMAFRVPTPNVSVVDL

SEQ ID NO: 45 - protein, 16 aa, Listeria monocytogenes
DGLTWHDGKPLTADDV

SEQ ID NO: 46 - protein, 20 aa, Mus sp.
DLYKSFVQNYPVVSIEDPFD

SEQ ID NO: 47 - protein, 9 aa, Mus sp.
SPITVEWRA

SEQ ID NO: 48 - protein, 16 aa, Mus sp.
TTSSYSNPTIGYENRV

SEQ ID NO: 49 - protein, 14 aa, Mus sp.
ISALEYGMPVTLIG

SEQ ID NO: 50 - protein, 8 aa, Mus sp.
AVYAFLGL

SEQ ID NO: 51 - protein, 18 aa, Mus sp.
YTWSDAAAPFAGLSTDQT

SEQ ID NO: 52 - protein, 17 aa, Mus sp.
NQLEALVGPEANVGPYG

SEQ ID NO: 53 - protein, 20 aa, Mus sp.
SEPTTLFKTASALRSSAPLN

SEQ ID NO: 54 - protein, 16 aa, Mus sp.
GLELEEPPLVLAAANV

SEQ ID NO: 55 - protein, 20 aa, Mus sp.
DEGKLLEAKGPVTDVAYSHD

SEQ ID NO: 56 - protein, 21 aa, Mus sp.
DEGKLLEAKGPVTDVAYSHDG

SEQ ID NO: 57 - protein, 21 aa, Mus sp.
IDLKGIPVYRFVLPANAFASP

SEQ ID NO: 58 - protein, 21 aa, Mus sp.
VDLYTAKGLFRAAVPSGASTG

SEQ ID NO: 59 - protein, 22 aa, Mus sp.
GPHSMRYFETAVSRPGLEEPRY

SEQ ID NO: 60 - protein, 8 aa, Mus sp.
SSIASFKD

SEQ ID NO: 61 - protein, 29 aa, Mus sp.
NVDPFKAVDTNRASMGQASPESKGFTDLL

SEQ ID NO: 62 - protein, 19 aa, Mus sp.
DDREDITHTYKYPEGSPEE

SEQ ID NO: 63 - protein, 17 aa, Mus sp.
LAPMYYRGAQAAIVVYD

SEQ ID NO: 64 - protein, 17 aa, Mus sp.
VDFVAWATGEPNFANDD

SEQ ID NO: 65 - protein, 18 aa, Mus sp.
YVPPPFAAAAINEAIDAE

SEQ ID NO: 66 - protein, 15 aa, Mus sp.
TIQWWNMPSPNVDPY

SEQ ID NO: 67 - protein, 18 aa, Listeria monocytogenes
EAKELVDNAPKALKEGIA

SEQ ID NO: 68 - protein, 17 aa, Mus sp.
EKEDRRYNPPIIHQGFQ

SEQ ID NO: 69 - protein, 18 aa, Mus sp.
VDFVAWATGEPNFANDDE

SEQ ID NO: 70 - protein, 16 aa, Mus sp.
SSIASFKDPKISTSLP

SEQ ID NO: 71 - protein, 15 aa, Mus sp.
TSSYSNPTIGYENRV

SEQ ID NO: 72 - protein, 19 aa, Mus sp.
YVDLDKKETVWMLPEFGQL

SEQ ID NO: 73 - protein, 17 aa, Mus sp.
LTGMAFRVPTPNVSVVD

SEQ ID NO: 74 - protein, 16 aa, Mus sp.
VFDVTAPNTFKTLDSW

SEQ ID NO: 75 - protein, 16 aa, Mus sp.
SGPKPFSAPKPQTSPS

SEQ ID NO: 76 - protein, 17 aa, Mus sp.
VPPPFAAAAINEAIDAE

SEQ ID NO: 77 - protein, 18 aa, Mus sp.
LPEEVGEYRQPSGGSVPV

SEQ ID NO: 78 - protein, 14 aa, Mus sp.
DHVDFSQPEPHTVL

SEQ ID NO: 79 - protein, 21 aa, Listeria monocytogenes
AVDDTTVKFTLPTVAPAFENT

SEQ ID NO: 80 - protein, 17 aa, Mus sp.
SYPFDFQGAKIITGQEE

SEQ ID NO: 81 - protein, 15 aa, Mus sp.
ELEEQLGPVAEETRA

SEQ ID NO: 82 - protein, 16 aa, Mus sp.
VELPPSVSQAAKSPPG

SEQ ID NO: 83 - protein, 12 aa, Mus sp.
STQLIRNGDWTF

SEQ ID NO: 84 - protein, 21 aa, Listeria monocytogenes
APGQETQHYYGLPVADSAIDR

SEQ ID NO: 85 - protein, 20 aa, Mus sp.
EKPVPAAPVPSPVAPAPVPS

SEQ ID NO: 86 - protein, 18 aa, Mus sp.
SADDFFQGTKAALAGGTT

SEQ ID NO: 87 - protein, 20 aa, Listeria monocytogenes
VDDTTVKFTLPTVAPAFENT

SEQ ID NO: 88 - protein, 15 aa, Mus sp.
EDPDGFSWPATLPSV

SEQ ID NO: 89 - protein, 18 aa, Mus sp.
LQSTDYGNFLANEASPLT

SEQ ID NO: 90 - protein, 15 aa, Mus sp.
IGDESVGRVVFGLFG

SEQ ID NO: 91 - protein, 17 aa, Mus sp.
LPSTWSDPSVNISLDNL

SEQ ID NO: 92 - protein, 25 aa, Mus sp.
ASFDPQGGLQNIAVVKHNLGVLTKR

SEQ ID NO: 93 - protein, 16 aa, Mus sp.
YDMNAANVGWNGSTFA

SEQ ID NO: 94 - protein, 15 aa, Mus sp.
TIPFYTPIPNGLYPS

SEQ ID NO: 95 - protein, 25 aa, Mus sp.
GAGIIDVIKSGYKIPELSQSLDYIQ

SEQ ID NO: 96 - protein, 21 aa, Mus sp.
NGNPLNSVFVAPAVTPVKGVL

SEQ ID NO: 97 - protein, 14 aa, Mus sp.
DPDGFSWPATLPSV

SEQ ID NO: 98 - protein, 16 aa, Mus sp.
LFPQYTAPSILPSDIT

SEQ ID NO: 99 - protein, 16 aa, Mus sp.
GSLGEYLFERLTLKHD

SEQ ID NO: 100 - protein, 20 aa, Mus sp.
KPTVTVVSPLPNDSINPQPS

SEQ ID NO: 101 - protein, 19 aa, Mus sp.
ITDKFWGPSGAESVIGGVH

SEQ ID NO: 102 - protein, 18 aa, Mus sp.
GSILWSQPLPSLPGGPPS

SEQ ID NO: 103 - protein, 17 aa, Mus sp.
INPDNVATPIAASFGDL

SEQ ID NO: 104 - protein, 16 aa, Mus sp.
EAPQATVFPKSPVLLG

SEQ ID NO: 105 - protein, 18 aa, Mus sp.
AGEFDYSGSQAIKALKEE

SEQ ID NO: 106 - protein, 18 aa, Mus sp.
IGDTIEFRGPNGLLVYQG

SEQ ID NO: 107 - protein, 24 aa, Mus sp.
LYCGGAEDPDVTASAERRLHKSPG

SEQ ID NO: 108 - protein, 9 aa, Mus sp.
FVLPANAFA

SEQ ID NO: 109 - protein, 19 aa, Mus sp.
MTFCKSNVINHFYCADPPL

SEQ ID NO: 110 - protein, 18 aa, Mus sp.
KKELEEQLGPVAEETRAR

SEQ ID NO: 111 - protein, 19 aa, Listeria monocytogenes
DDTTVKFTLPTVAPAFENT

SEQ ID NO: 112 - protein, 15 aa, Listeria monocytogenes
YPGSDETPPVVNPGE

SEQ ID NO: 113 - protein, 13 aa, Mus sp.
FGNIYSTPLALQM

SEQ ID NO: 114 - protein, 17 aa, Mus sp.
FGNSEFDPPGPNVATTT

SEQ ID NO: 115 - protein, 10 aa, Mus sp.
ALPKAVVKLD

SEQ ID NO: 116 - protein, 18 aa, Mus sp.
NRDGDSYRSPWSNKYDPP

SEQ ID NO: 117 - protein, 11 aa, Mus sp.
VLAPQVVLSLG

SEQ ID NO: 118 - protein, 25 aa, Mus sp.
ITGLDPAGPNFEYAEAPSRLSPDDA

SEQ ID NO: 119 - protein, 17 aa, Mus sp.
VFDVTAPNTFKTLDSWR

SEQ ID NO: 120 - protein, 17 aa, Mus sp.
GPNFEYAEAPSRLSPDD

SEQ ID NO: 121 - protein, 14 aa, Mus sp.
IPFYTPIPNGLYPS

SEQ ID NO: 122 - protein, 17 aa, Mus sp.
AGEFDYSGSQAIKALKE

SEQ ID NO: 123 - protein, 21 aa, Mus sp.
QPTGPPPYHESLAGASQPPYN

SEQ ID NO: 124 - protein, 16 aa, Mus sp.
ELEEQLGPVAEETRAR

SEQ ID NO: 125 - protein, 14 aa, Mus sp.
GTPDYIAPEILQGL

SEQ ID NO: 126 - protein, 19 aa, Mus sp.
LPQDPTFHTPLDLYAYARA

SEQ ID NO: 127 - protein, 21 aa, Mus sp.
CALLTLRWPRPLTTLATAVTG

SEQ ID NO: 128 - protein, 18 aa, Mus sp.
LPGNLDYWTYPGSLTTPP

SEQ ID NO: 129 - protein, 17 aa, Mus sp.
GPGSAVSPYPSFNVSSD

SEQ ID NO: 130 - protein, 26 aa, Mus sp.
VDPTPDPNTAYASYPSASVENYQQPP

SEQ ID NO: 131 - protein, 16 aa, Mus sp.
VDMARVVAPFMSNIPL

SEQ ID NO: 132 - protein, 24 aa, Mus sp.
GPPGFEDYVELPPSVSQAAKSPPG

SEQ ID NO: 133 - protein, 20 aa, Mus sp.
DGEEAGAYDGPRTADGIVSH

SEQ ID NO: 134 - protein, 18 aa, Mus sp.
GPNFEYAEAPSRLSPDDA

SEQ ID NO: 135 - protein, 27 aa, Mus sp.
YVDPTPDPNTAYASYPSASVENYQQPP

SEQ ID NO: 136 - protein, 16 aa, Mus sp.
AEPQAEAPAAAASSEQ

SEQ ID NO: 137 - protein, 14 aa, Mus sp.
AVLEQEPIVLPAWD

SEQ ID NO: 138 - protein, 14 aa, Mus sp.
FEYAEAPSRLSPDD

SEQ ID NO: 139 - protein, 19 aa, Mus sp.
GKLLEAKGPVTDVAYSHDG

SEQ ID NO: 140 - protein, 13 aa, Mus sp.
LPQDPTFHTPLDL

SEQ ID NO: 141 - protein, 16 aa, Mus sp.
LITGVDFIGSTVGLAK

SEQ ID NO: 142 - protein, 9 aa, Mus sp.
KIFEFKETL

SEQ ID NO: 143 - protein, 17 aa, Mus sp.
SGPKPFSAPKPQTSPSP

SEQ ID NO: 144 - protein, 18 aa, Mus sp.
TWSDAAAPFAGLSTDQTL

SEQ ID NO: 145 - protein, 15 aa, Mus sp.
EDRRYNPPIIHQGFQ

SEQ ID NO: 146 - protein, 16 aa, Mus sp.
SSVAFIKPGVNKAEVT

SEQ ID NO: 147 - protein, 18 aa, Mus sp.
SLVLFCRVYRVWVLVVGG

SEQ ID NO: 148 - protein, 17 aa, Mus sp.
NPPSYYTQPVPVPNANA

SEQ ID NO: 149 - protein, 13 aa, Mus sp.
IYEGYALPHAILR

SEQ ID NO: 150 - protein, 16 aa, Mus sp.
DDARVYHDPSTQEPVT

SEQ ID NO: 151 - protein, 26 aa, Mus sp.
TTILYKLKGNQLVDTLPTVGFNVEPL

SEQ ID NO: 152 - protein, 15 aa, Mus sp.
GYKPFQNPVPNQSPS

SEQ ID NO: 153 - protein, 16 aa, Mus sp.
WKPGSDTIKPDVNKSK

SEQ ID NO: 154 - protein, 15 aa, Mus sp.
EAGAYDGPRTADGIV

SEQ ID NO: 155 - protein, 16 aa, Mus sp.
IGGDPFAAPQVVPAFA

SEQ ID NO: 156 - protein, 17 aa, Mus sp.
GPPPYHESLAGASQPPY

SEQ ID NO: 157 - protein, 18 aa, Mus sp.
NKPEDYQGGRTGEAIVDA

SEQ ID NO: 158 - protein, 20 aa, Mus sp.
IGDTIEFRGPNGLLVYQGKG

SEQ ID NO: 159 - protein, 15 aa, Mus sp.
VYIFYGASIASLSAS

SEQ ID NO: 160 - protein, 14 aa, Mus sp.
AGGHKLGLGLEFQA

SEQ ID NO: 161 - protein, 20 aa, Mus sp.
AQPTGPPPYHESLAGASQPP

SEQ ID NO: 162 - protein, 14 aa, Mus sp.
SKTVYALPTIAFAF

SEQ ID NO: 163 - protein, 16 aa, Mus sp.
GGPGSAVSPYPSFNVS

SEQ ID NO: 164 - protein, 15 aa, Mus sp.
GPVPWLGPQTDEAIK

SEQ ID NO: 165 - protein, 15 aa, Mus sp.
LPDVYDWPESSLTPP

SEQ ID NO: 166 - protein, 19 aa, Mus sp.
SEPTTLFKTASALRSSAPL

SEQ ID NO: 167 - protein, 16 aa, Mus sp.
NTAQYKCPVAMEEADD

SEQ ID NO: 168 - protein, 16 aa, Mus sp.
ISVAVATPRGLVVPVI

SEQ ID NO: 169 - protein, 17 aa, Mus sp.
VGTARYMAPEVLESRMN

SEQ ID NO: 170 - protein, 17 aa, Mus sp.
KKELEEQLGPVAEETRA

SEQ ID NO: 171 - protein, 25 aa, Mus sp.
TPARAPETRSQVTPSVPSEALDDST

SEQ ID NO: 172 - protein, 18 aa, Mus sp.
YPPSGPTYRGPVPWHTIN

SEQ ID NO: 173 - protein, 16 aa, Mus sp.
DRKIVYEGPELNHAFG

SEQ ID NO: 174 - protein, 16 aa, Mus sp.
FQHPYNTLKYPNGEGG

SEQ ID NO: 175 - protein, 19 aa, Mus sp.
SPLPILSPTVSPSPSPIPP

SEQ ID NO: 176 - protein, 8 aa, Mus sp.
VNIEFKDL

SEQ ID NO: 177 - protein, 17 aa, Mus sp.
LEFIDVHVKLPRFKIEE

SEQ ID NO: 178 - protein, 25 aa, Listeria monocytogenes
DFRYVFDTAKATAASSYPGSDETPP

SEQ ID NO: 179 - protein, 15 aa, BOVIN
SVVVGPSVVAVPLPL

SEQ ID NO: 180 - protein, 16 aa, Mus sp.
VYIFYGASIASLSASH

SEQ ID NO: 181 - protein, 15 aa, Mus sp.
TDKFWGPSGAESVIG

SEQ ID NO: 182 - protein, 28 aa, Mus sp.
EKWEETELDQLFSGPLPGRLPVNHRPFS

SEQ ID NO: 183 - protein, 21 aa, Mus sp.
EKWEETELDQLFSGPLPGRLP

SEQ ID NO: 184 - protein, 11 aa, Mus sp.
EDRRYNPPIIH

SEQ ID NO: 185 - protein, 23 aa, Mus sp.
ASFDPQGGLQNIAVVKHNLGVLT

SEQ ID NO: 186 - protein, 18 aa, Mus sp.
AGPNFEYAEAPSRLSPDD

SEQ ID NO: 187 - protein, 18 aa, Mus sp.
DDEKVRVSYYGPKTSPVQ

SEQ ID NO: 188 - protein, 16 aa, BOVIN
SVVVGPSVVAVPLPLH

SEQ ID NO: 189 - protein, 18 aa, Mus sp.
STHSNSISFGSAPTTSVS

SEQ ID NO: 190 - protein, 15 aa, Mus sp.
VDMARVVAPFMSNIP

SEQ ID NO: 191 - protein, 23 aa, Mus sp.
LPEEVGEYRQPSGGSVPVSPGPP

SEQ ID NO: 192 - protein, 22 aa, Mus sp.
KPAAAKPAATRPLAAAIRPVAT

SEQ ID NO: 193 - protein, 19 aa, Mus sp.
YPPSGPTYRGPVPWHTINL

SEQ ID NO: 194 - protein, 19 aa, Mus sp.
SAPVEGASPTSISAVDGLT

SEQ ID NO: 195 - protein, 15 aa, Mus sp.
EVGEYRQPSGGSVPV

SEQ ID NO: 196 - protein, 18 aa, Mus sp.
DGDSVVFAGPAGNSVETR

SEQ ID NO: 197 - protein, 21 aa, Mus sp.
EDGELTYENVQVSPVPGGPPG

SEQ ID NO: 198 - protein, 16 aa, Mus sp.
SLVSWVGSEPMPEAGL

SEQ ID NO: 199 - protein, 17 aa, Mus sp.
TGMAFRVPTPNVSVVDL

SEQ ID NO: 200 - protein, 26 aa, Mus sp.
GPSAPATPAAEAKAAEAAASAYYNPG

SEQ ID NO: 201 - protein, 17 aa, Mus sp.
TDRKIVYEGPELNHAFG

SEQ ID NO: 202 - protein, 10 aa, Mus sp.
DPKISTSLPV

SEQ ID NO: 203 - protein, 17 aa, Mus sp.
NPLNSVFVAPAVTPVKG

SEQ ID NO: 204 - protein, 15 aa, Mus sp.
AVLEQEPIVLPAWDP

SEQ ID NO: 205 - protein, 12 aa, Mus sp.
SVFVAPAVTPVK

SEQ ID NO: 206 - protein, 17 aa, Mus sp.
WKPGSDTIKPDVNKSKE

SEQ ID NO: 207 - protein, 13 aa, Mus sp.
TPDYIAPEILQGL

SEQ ID NO: 208 - protein, 18 aa, Mus sp.
IGGDTHFDSAEPWTVQNE

SEQ ID NO: 209 - protein, 14 aa, Mus sp.
TSSYSNPTIGYENR

SEQ ID NO: 210 - protein, 33 aa, Listeria monocytogenes
RYVFDTAKATAASSYPGSDETPPVVNPGETNPP

SEQ ID NO: 211 - protein, 13 aa, Mus sp.
DVFLGPYVAVFDR

SEQ ID NO: 212 - protein, 16 aa, Mus sp.
YVPWNFHEPQPGQYEF

SEQ ID NO: 213 - protein, 8 aa, Mus sp.
SVLQFLGL

SEQ ID NO: 214 - protein, 21 aa, Mus sp.
LPGNLDYWTYPGSLTTPPLLE

SEQ ID NO: 215 - protein, 14 aa, Mus sp.
VATNPIITPVAQEN

SEQ ID NO: 216 - protein, 12 aa, Mus sp.
MKNKELIPLAFF

SEQ ID NO: 217 - protein, 10 aa, Mus sp.
LSYIGPSVNK

SEQ ID NO: 218 - protein, 23 aa, Mus sp.
EPGLFEWTKWVAGSTLPAWIPPS

SEQ ID NO: 219 - protein, 18 aa, Listeria monocytogenes
GLLMAKKYKMNLTIVIVN

SEQ ID NO: 220 - protein, 15 aa, Mus sp.
FGNSEFDPPGPNVAT

SEQ ID NO: 221 - protein, 19 aa, Mus sp.
SELERESKVVVPPLPGKAF

SEQ ID NO: 222 - protein, 25 aa, Mus sp.
GPPIDIGRVTGPPIFNPVANEVYLN

SEQ ID NO: 223 - protein, 15 aa, Mus sp.
LDQLFSGPLPGRLPV

SEQ ID NO: 224 - protein, 15 aa, Mus sp.
ITGVDFIGSTVGLAK

SEQ ID NO: 225 - protein, 21 aa, Mus sp.
VLITDKFWGPSGAESVIGGVH

SEQ ID NO: 226 - protein, 18 aa, Mus sp.
IESKEAFQEALAAAGDKL

SEQ ID NO: 227 - protein, 14 aa, Mus sp.
AFSNPSAGISVDVK

SEQ ID NO: 228 - protein, 13 aa, Mus sp.
NSEFDPPGPNVAT

SEQ ID NO: 229 - protein, 17 aa, Mus sp.
AARDNMFSGSKINYTEN

SEQ ID NO: 230 - protein, 18 aa, Mus sp.
FHQRFESPDSQASAEQPE

SEQ ID NO: 231 - protein, 14 aa, Mus sp.
LQVYAPEVSPESIM

SEQ ID NO: 232 - protein, 15 aa, Mus sp.
SFVQNYPVVSIEDPF

SEQ ID NO: 233 - protein, 17 aa, Mus sp.
LTTSSYSNPTIGYENRV

SEQ ID NO: 234 - protein, 19 aa, Mus sp.
IQASVATNPIITPVAQENQ

SEQ ID NO: 235 - protein, 26 aa, Mus sp.
VEWTNNGKTELNYKNTEPVLDSDGSY

SEQ ID NO: 236 - protein, 24 aa, Mus sp.
GPPGFEDYVELPPSVSQAATSPPG

SEQ ID NO: 237 - protein, 16 aa, Mus sp.
DGELTYENVQVSPVPG

SEQ ID NO: 238 - protein, 12 aa, Mus sp.
LIRNGDWTFQVL

SEQ ID NO: 239 - protein, 16 aa, Mus sp.
DDLFVEEPKTNDVKDS

SEQ ID NO: 240 - protein, 25 aa, Mus sp.
DAGTIAGLNVLRIINEPTAAAIAYG

SEQ ID NO: 241 - protein, 22 aa, Listeria monocytogenes
YVFDTAKATAASSYPGSDETPP

SEQ ID NO: 242 - protein, 23 aa, Mus sp.
GPDGKGMNPPSYYTQPVPVPNAN

SEQ ID NO: 243 - protein, 20 aa, Mus sp.
SKIETLTLAKNYIKSLTATI

SEQ ID NO: 244 - protein, 16 aa, Mus sp.
KPEDYQGGRTGEAIVD

SEQ ID NO: 245 - protein, 15 aa, Mus sp.
THDLYIQSHISENRE

SEQ ID NO: 246 - protein, 16 aa, Mus sp.
IMLLYNGPKVNLVIIK

SEQ ID NO: 247 - protein, 19 aa, Mus sp.
MPNPKDNEVNHIRATCFNS

SEQ ID NO: 248 - protein, 17 aa, Mus sp.
YIEGYVPSQADVAVFEA

SEQ ID NO: 249 - protein, 17 aa, Mus sp.
GYAVYETPTAHNGAKNP

SEQ ID NO: 250 - protein, 17 aa, Mus sp.
MPEMNIKAPKISMPDID

SEQ ID NO: 251 - protein, 15 aa, Mus sp.
LGDVFLGPYVAVFDR

SEQ ID NO: 252 - protein, 12 aa, Mus sp.
DHVDFSQPEPHT

SEQ ID NO: 253 - protein, 21 aa, Mus sp.
TPSPESPDQWSSSSPHSASDW

SEQ ID NO: 254 - protein, 19 aa, Mus sp.
IDLKGIPVYRFVLPANAFA

SEQ ID NO: 255 - protein, 24 aa, Mus sp.
ITGLDPAGPNFEYAEAPSRLSPDD

SEQ ID NO: 256 - protein, 20 aa, Mus sp.
VDLYTAKGLFRAAVPSGAST

SEQ ID NO: 257 - protein, 21 aa, Listeria monocytogenes
ESVYLSAQKENPRLFAKIETF

SEQ ID NO: 258 - protein, 23 aa, Mus sp.
LDPAGPNFEYAEAPSRLSPDDAD

SEQ ID NO: 259 - protein, 14 aa, Mus sp.
VATENGYSYPVVSY

SEQ ID NO: 260 - protein, 24 aa, Mus sp.
YVDPTPDPNTAYASYPSASVENYQ

SEQ ID NO: 261 - protein, 16 aa, Mus sp.
EAGAYDGPRTADGIVS

SEQ ID NO: 262 - protein, 16 aa, Mus sp.
GVPTVPLLPPQVNQSL

SEQ ID NO: 263 - protein, 21 aa, Mus sp.
IGYREYSTGGNFQFNIISIDT

SEQ ID NO: 264 - protein, 18 aa, Mus sp.
DHAISDLSMYNYIEMRAH

SEQ ID NO: 265 - protein, 17 aa, Mus sp.
GLDSQGCFCAGCSRQIG

SEQ ID NO: 266 - protein, 14 aa, Mus sp.
ELEEQLGPVAEETR

SEQ ID NO: 267 - protein, 11 aa, Mus sp.
FHNPHVNPLPT

SEQ ID NO: 268 - protein, 14 aa, Mus sp.
GAPFDWEGAQASQA

SEQ ID NO: 269 - protein, 18 aa, Mus sp.
FAAEEFKVPAATSAIITN

SEQ ID NO: 270 - protein, 19 aa, Mus sp.
KEDRRYNPPIIHQGFQDTS

SEQ ID NO: 271 - protein, 15 aa, Mus sp.
GIPVYRFVLPANAFA

SEQ ID NO: 272 - protein, 12 aa, Mus sp.
WTISPVPQSIVD

SEQ ID NO: 273 - protein, 15 aa, Mus sp.
SLFLKTPKIVSSKDY

SEQ ID NO: 274 - protein, 17 aa, Mus sp.
RPVFDWKDPLILEEQLT

SEQ ID NO: 275 - protein, 18 aa, Mus sp.
SYPFDFQGAKIITGQEEG

SEQ ID NO: 276 - protein, 17 aa, Mus sp.
SPDVVYSPETIEARYEY

SEQ ID NO: 277 - protein, 22 aa, BOVIN
AGPPVASVVVGPSVVAVPLPLH

SEQ ID NO: 278 - protein, 14 aa, Mus sp.
SKATYSTNSPVWEE

SEQ ID NO: 279 - protein, 21 aa, Mus sp.
DDGHGGYKPFQNPVPNQSPSS

SEQ ID NO: 280 - protein, 17 aa, Mus sp.
TKNLDYVATSIHEAVTK

SEQ ID NO: 281 - protein, 14 aa, Mus sp.
FPYVTPAPHEPVKT

SEQ ID NO: 282 - protein, 13 aa, Mus sp.
LPDFHVPEITIPE

SEQ ID NO: 283 - protein, 15 aa, Mus sp.
SKNVFLSPMSISSAL

SEQ ID NO: 284 - protein, 18 aa, Mus sp.
GKLLEAKGPVTDVAYSHD

SEQ ID NO: 285 - protein, 18 aa, Mus sp.
EKTGQEYKPGNPSAAAVQ

SEQ ID NO: 286 - protein, 14 aa, Mus sp.
ISVAVATPRGLVVP

SEQ ID NO: 287 - protein, 10 aa, Mus sp.
YTPIPNGLYP

SEQ ID NO: 288 - protein, 16 aa, Mus sp.
NPLNSVFVAPAVTPVK

SEQ ID NO: 289 - protein, 19 aa, Mus sp.
EAARDNMFSGSKINYTENR

SEQ ID NO: 290 - protein, 17 aa, Mus sp.
YKKELEEQLGPVAEETR

SEQ ID NO: 291 - protein, 18 aa, Mus sp.
SWKTFLKYSEEVLAVFKS

SEQ ID NO: 292 - protein, 16 aa, Mus sp.
AVDALASSHPLSSPAD

SEQ ID NO: 293 - protein, 20 aa, Mus sp.
DLPKNWDWRNVNGVNYASVT

SEQ ID NO: 294 - protein, 12 aa, Mus sp.
NWSLPNRAVEPQ

SEQ ID NO: 295 - protein, 17 aa, Mus sp.
WSDAAAPFAGLSTDQTL

SEQ ID NO: 296 - protein, 20 aa, Mus sp.
YPTPAYTIPFYTPIPNGLYP

SEQ ID NO: 297 - protein, 15 aa, Mus sp.
YFETAVSRPGLEEPR

SEQ ID NO: 298 - protein, 18 aa, Mus sp.
EKEDRRYNPPIIHQGFQD

SEQ ID NO: 299 - protein, 21 aa, Mus sp.
LVTYVPVTTFKNLQTVNVDEN

SEQ ID NO: 300 - protein, 16 aa, Mus sp.
NLDYWTYPGSLTTPPL

SEQ ID NO: 301 - protein, 15 aa, Mus sp.
NRPAFMPSEGRMVSD

SEQ ID NO: 302 - protein, 17 aa, Mus sp.
SLQAFSNPSAGISVDVK

SEQ ID NO: 303 - protein, 12 aa, Mus sp.
DDIEADHVGTYG

SEQ ID NO: 304 - protein, 16 aa, Mus sp.
NIPYFETSAKEAINVE

SEQ ID NO: 305 - protein, 19 aa, Mus sp.
QPPPAYEPPAPAPAPLPPP

SEQ ID NO: 306 - protein, 18 aa, Mus sp.
TALTFSSPATNQAITIPV

SEQ ID NO: 307 - protein, 16 aa, Mus sp.
AGGDARNKKLPNGPAF

SEQ ID NO: 308 - protein, 20 aa, Mus sp.
ESTEQLPNVQVEGPTPNRPR

SEQ ID NO: 309 - protein, 19 aa, Mus sp.
DPAVIKSLTIQPDPIVVPG

SEQ ID NO: 310 - protein, 15 aa, Mus sp.
DISNYGFPRSVQAID

SEQ ID NO: 311 - protein, 17 aa, Mus sp.
KPEDYQGGRTGEAIVDA

SEQ ID NO: 312 - protein, 8 aa, Mus sp.
AVYTFETL

SEQ ID NO: 313 - protein, 18 aa, Listeria monocytogenes
GGINQAYTGSTALSDGLN

SEQ ID NO: 314 - protein, 18 aa, Mus sp.
TPIPQSGSPFPASVQDPG

SEQ ID NO: 315 - protein, 17 aa, Mus sp.
DPTNPFRFPNIGVEKFL

SEQ ID NO: 316 - protein, 16 aa, Mus sp.
WQKIQEPYTFPAILKS

SEQ ID NO: 317 - protein, 16 aa, Mus sp.
DELSKTISPMVMDAKA

SEQ ID NO: 318 - protein, 14 aa, Mus sp.
GVLLPFFDPDTNIV

SEQ ID NO: 319 - protein, 20 aa, Mus sp.
FPKPPSYNVATTLPSYDEAE

SEQ ID NO: 320 - protein, 20 aa, Mus sp.
YPPSGPTYRGPVPWHTINLD

SEQ ID NO: 321 - protein, 18 aa, Mus sp.
YPTPAYTIPFYTPIPNGL

SEQ ID NO: 322 - protein, 20 aa, Mus sp.
MIPVWPFPYLSVGTMLKNLN

SEQ ID NO: 323 - protein, 13 aa, Mus sp.
VQNYPVVSIEDPF

SEQ ID NO: 324 - protein, 12 aa, Mus sp.
TSWLDGKHVVFG

SEQ ID NO: 325 - protein, 16 aa, Mus sp.
APVEGASPTSISAVDG

SEQ ID NO: 326 - protein, 22 aa, Mus sp.
VDPTPDPNTAYASYPSASVENY

SEQ ID NO: 327 - protein, 20 aa, Mus sp.
EDGELTYENVQVSPVPGGPP

SEQ ID NO: 328 - protein, 24 aa, Mus sp.
FPGPNIGGDTHFDSAEPWTVQNED

SEQ ID NO: 329 - protein, 17 aa, Mus sp.
RRTDWEAPTGQPSAPGP

SEQ ID NO: 330 - protein, 14 aa, Mus sp.
SLEDFYGSPIPSVS

SEQ ID NO: 331 - protein, 20 aa, Mus sp.
TPSAAYLWVGAGASEAEKTG

SEQ ID NO: 332 - protein, 16 aa, Mus sp.
GIPVYRFVLPANAFAS

SEQ ID NO: 333 - protein, 15 aa, Mus sp.
GAPFDWEGAQASQAL

SEQ ID NO: 334 - protein, 19 aa, Mus sp.
SPESPDQWSSSSPHSASDW

SEQ ID NO: 335 - protein, 23 aa, Mus sp.
TPSPESPDQWSSSSPHSASDWSD

SEQ ID NO: 336 - protein, 19 aa, Mus sp.
LPDDINVYATTAANPKESS

SEQ ID NO: 337 - protein, 15 aa, Mus sp.
FPYEGPAPLEAIANG

SEQ ID NO: 338 - protein, 15 aa, Mus sp.
LALPYDTPVPGYMNN

SEQ ID NO: 339 - protein, 20 aa, Mus sp.
GAEIEYAMAYSKAAFERESD

SEQ ID NO: 340 - protein, 20 aa, Mus sp.
DDGHGGYKPFQNPVPNQSPS

SEQ ID NO: 341 - protein, 26 aa, Mus sp.
VIPELNGKLTGMAFRVPTPNVSVVDL

SEQ ID NO: 342 - protein, 26 aa, Mus sp.
IPISKVKDVYVITDQIPVFVTMSQKN

SEQ ID NO: 343 - protein, 20 aa, Mus sp.
NWPHLEEARVVAVSDGETKF

SEQ ID NO: 344 - protein, 24 aa, Mus sp.
LDPAGPNFEYAEAPSRLSPDDADF

SEQ ID NO: 345 - protein, 17 aa, Mus sp.
PLKEDNWSLPNRAVEPQ

SEQ ID NO: 346 - protein, 16 aa, Mus sp.
AQLNYWSAKSLWAKLD

SEQ ID NO: 347 - protein, 17 aa, Mus sp.
ARDNMFSGSKINYTENR

SEQ ID NO: 348 - protein, 16 aa, Mus sp.
TITVYSFPESVELRPL

SEQ ID NO: 349 - protein, 23 aa, Mus sp.
DESGFPKPPSYNVATTLPSYDEA

SEQ ID NO: 350 - protein, 15 aa, Mus sp.
LSLLYNVPAVAEEIQ

SEQ ID NO: 351 - protein, 24 aa, Mus sp.
LPEEVGEYRQPSGGSVPVSPGPPS

SEQ ID NO: 352 - protein, 21 aa, Mus sp.
EMEKEDRRYNPPIIHQGFQDT

SEQ ID NO: 353 - protein, 20 aa, Mus sp.
EPPPAYEPPAPAPAPLPPPS

SEQ ID NO: 354 - protein, 16 aa, Mus sp.
DSVVFAGPAGNSVETR

SEQ ID NO: 355 - protein, 15 aa, Mus sp.
TVTYEWAPPVQNQAL

SEQ ID NO: 356 - protein, 21 aa, Mus sp.
KPTVTVVSPLPNDSINPQPSP

SEQ ID NO: 357 - protein, 15 aa, Mus sp.
LELEEPPLVLAAANV

SEQ ID NO: 358 - protein, 16 aa, Mus sp.
PPSYYTQPVPVPNANA

SEQ ID NO: 359 - protein, 16 aa, Mus sp.
GTVIHFNNPKVQASLA

SEQ ID NO: 360 - protein, 16 aa, Mus sp.
LDQLFSGPLPGRLPVN

SEQ ID NO: 361 - protein, 22 aa, Mus sp.
DPAGPNFEYAEAPSRLSPDDAD

SEQ ID NO: 362 - protein, 20 aa, Mus sp.
APSEERVYMVGKANSVFEDL

SEQ ID NO: 363 - protein, 26 aa, Mus sp.
TPARAPETRSQVTPSVPSEALDDSTG

SEQ ID NO: 364 - protein, 17 aa, Mus sp.
DPAEYDVSPETRRAQVE

SEQ ID NO: 365 - protein, 18 aa, Mus sp.
VPSVIYTHPEVAWVGKSE

SEQ ID NO: 366 - protein, 19 aa, Mus sp.
DTGENPIYKSAVTTVVNPK

SEQ ID NO: 367 - protein, 11 aa, Mus sp.
VFVAPAVTPVK

SEQ ID NO: 368 - protein, 18 aa, Mus sp.
SVPPSVSPSPATAFSGPP

SEQ ID NO: 369 - protein, 14 aa, Mus sp.
IETIVAAMSNLVPP

SEQ ID NO: 370 - protein, 16 aa, Mus sp.
SIASFKDPKISTSLPV

SEQ ID NO: 371 - protein, 16 aa, Mus sp.
YYLPYKSPGINVDSSY

SEQ ID NO: 372 - protein, 18 aa, Mus sp.
SSIASFKDPKISTSLPVL

SEQ ID NO: 373 - protein, 17 aa, Mus sp.
IDPYDQPNAIYIERHEP

SEQ ID NO: 374 - protein, 17 aa, Mus sp.
TWSDAAAPFAGLSTDQT

SEQ ID NO: 375 - protein, 21 aa, Mus sp.
IKVPDVDISSPGINVEAPDIH

SEQ ID NO: 376 - protein, 24 aa, Mus sp.
NVDPFKAVDTNRASMGQASPESKG

SEQ ID NO: 377 - protein, 15 aa, Mus sp.
DDPIWRGPLPSNGVM

SEQ ID NO: 378 - protein, 20 aa, Mus sp.
EEKPVPAAPVPSPVAPAPVP

SEQ ID NO: 379 - protein, 19 aa, Mus sp.
TGTTVYRQFWIFDVQNPDD

SEQ ID NO: 380 - protein, 15 aa, Mus sp.
VELPPSVSQAAKSPP

SEQ ID NO: 381 - protein, 9 aa, Mus sp.
QILSDFPKL

SEQ ID NO: 382 - protein, 16 aa, Mus sp.
LGFPYEGPAPLEAIAN

SEQ ID NO: 383 - protein, 15 aa, Mus sp.
AISYVAALPAAALWH

SEQ ID NO: 384 - protein, 16 aa, Mus sp.
YNPEAMVAPSVLSNIQ

SEQ ID NO: 385 - protein, 18 aa, Mus sp.
IPITYPTTAPEIAVPELD

SEQ ID NO: 386 - protein, 11 aa, Mus sp.
IPFYTPIPNGL

SEQ ID NO: 387 - protein, 18 aa, Mus sp.
VSPTVHFTPAEISRSVFE

SEQ ID NO: 388 - protein, 22 aa, Mus sp.
KDEGKLLEAKGPVTDVAYSHDG

SEQ ID NO: 389 - protein, 16 aa, Mus sp.
NVDPFKAVDTNRASMG

SEQ ID NO: 390 - protein, 16 aa, Mus sp.
KPSQAGWFDQIAVKVA

SEQ ID NO: 391 - protein, 17 aa, Mus sp.
YVTQFHPPHIEIQMLKN

SEQ ID NO: 392 - protein, 19 aa, Mus sp.
GPDGRFVMGPTVAPSQEKL

SEQ ID NO: 393 - protein, 13 aa, Mus sp.
SVFVAPAVTPVKG

SEQ ID NO: 394 - protein, 16 aa, Mus sp.
GCKVRDHMVVLHDQGE

SEQ ID NO: 395 - protein, 17 aa, Mus sp.
ISALEYGMPVTLIGEAV

SEQ ID NO: 396 - protein, 16 aa, Mus sp.
VGAGHFRSPHTTEVVG

SEQ ID NO: 397 - protein, 14 aa, Mus sp.
INYQPPTVVPGGDL

SEQ ID NO: 398 - protein, 15 aa, Mus sp.
GELTYENVQVSPVPG

SEQ ID NO: 399 - protein, 15 aa, Mus sp.
IYEGYALPHAILRLD

SEQ ID NO: 400 - protein, 12 aa, Mus sp.
VQIYHNPTANSF

SEQ ID NO: 401 - protein, 19 aa, Mus sp.
SSSIASFKDPKISTSLPVL

SEQ ID NO: 402 - protein, 22 aa, Mus sp.
NDQGNRITPSYVAFTPEGERLI

SEQ ID NO: 403 - protein, 17 aa, Mus sp.
VPTDKYYGAQTVRSTMN

SEQ ID NO: 404 - protein, 21 aa, Mus sp.
NPEPPPPRSHYSNIEANESEE

SEQ ID NO: 405 - protein, 16 aa, Mus sp.
GAPFDWEGAQASQALL

SEQ ID NO: 406 - protein, 19 aa, Mus sp.
INTVTYEWAPPVQNQALAR

SEQ ID NO: 407 - protein, 14 aa, Mus sp.
LPYKSPGINVDSSY

SEQ ID NO: 408 - protein, 25 aa, Mus sp.
KKHVPEEVLAVLEQEPIVLPAWDPM

SEQ ID NO: 409 - protein, 15 aa, Mus sp.
VELPPSVSQAATSPP

SEQ ID NO: 410 - protein, 19 aa, Mus sp.
LAPMYYRGAQAAIVVYDIT

SEQ ID NO: 411 - protein, 18 aa, Mus sp.
TGTTVYRQFWIFDVQNPD

SEQ ID NO: 412 - protein, 17 aa, Mus sp.
TGPPPYHESLAGASQPP

SEQ ID NO: 413 - protein, 25 aa, Mus sp.
VIPELNGKLTGMAFRVPTPNVSVVD

SEQ ID NO: 414 - protein, 12 aa, Mus sp.
IQEPYTFPAILK

SEQ ID NO: 415 - protein, 20 aa, Mus sp.
SSSIASFKDPKISTSLPVLD

SEQ ID NO: 416 - protein, 21 aa, Mus sp.
LPEGDISISGPKVNVEAPNVN

SEQ ID NO: 417 - protein, 18 aa, Mus sp.
SSSIASFKDPKISTSLPV

SEQ ID NO: 418 - protein, 15 aa, Mus sp.
TPWKAPIVWEGTYDT

SEQ ID NO: 419 - protein, 17 aa, Mus sp.
GTSWTYNPAAVSKVAPA

SEQ ID NO: 420 - protein, 31 aa, Listeria monocytogenes
KTASGIVLPDSAKEKPQSGKIVAVGSGRVLD

SEQ ID NO: 421 - protein, 17 aa, Mus sp.
SSSIASFKDPKISTSLP

SEQ ID NO: 422 - protein, 21 aa, Mus sp.
DYNRDGDSYRSPWSNKYDPPL

SEQ ID NO: 423 - protein, 16 aa, Mus sp.
EDNVYHSSNAVYRAPS

SEQ ID NO: 424 - protein, 20 aa, Mus sp.
VQIPKVVKSPSSLPAKPLVP

SEQ ID NO: 425 - protein, 12 aa, Mus sp.
TIPFYTPIPNGL

SEQ ID NO: 426 - protein, 17 aa, Mus sp.
KELSFAPPMSDRSGDGI

SEQ ID NO: 427 - protein, 16 aa, Mus sp.
HIEVWERPLSNLAWAV

SEQ ID NO: 428 - protein, 15 aa, Mus sp.
VEPYEVHNPVPLIVG

SEQ ID NO: 429 - protein, 22 aa, Mus sp.
INPDEAVAYGAAVQAAILSGDK

SEQ ID NO: 430 - protein, 23 aa, Mus sp.
ADHVGTYGISVYQSPGDIGQYTF

SEQ ID NO: 431 - protein, 20 aa, Mus sp.
SSRAVYLSSKLRGVSLQTTG

SEQ ID NO: 432 - protein, 15 aa, Mus sp.
RKIVYEGPELNHAFG

SEQ ID NO: 433 - protein, 17 aa, Mus sp.
GQNAWFLPAQADIVATK

SEQ ID NO: 434 - protein, 19 aa, Mus sp.
SPGILQASPTPLLAAAAPA

SEQ ID NO: 435 - protein, 19 aa, Mus sp.
LPGNLDYWTYPGSLTTPPL

SEQ ID NO: 436 - protein, 29 aa, Mus sp.
QPGATTVQEQLRQLFERDWSSHYAMDLDR

SEQ ID NO: 437 - protein, 15 aa, Mus sp.
LDYWTYPGSLTTPPL

SEQ ID NO: 438 - protein, 21 aa, Listeria monocytogenes
STVVVEAGDTLWGIAQSKGTT

SEQ ID NO: 439 - protein, 15 aa, Mus sp.
SIVYWMTSQPSDAVR

SEQ ID NO: 440 - protein, 19 aa, Listeria monocytogenes
GTKEKVVATPVSNVSTSSA

SEQ ID NO: 441 - protein, 16 aa, Mus sp.
AARDNMFSGSKINYTE

SEQ ID NO: 442 - protein, 16 aa, Mus sp.
DHVDFSQPEPHTVLFH

SEQ ID NO: 443 - protein, 15 aa, Mus sp.
AEVEFSAPYPMEVIF

SEQ ID NO: 444 - protein, 17 aa, Mus sp.
GGPGSAVSPYPSFNVSS

SEQ ID NO: 445 - protein, 15 aa, BOVIN
ASVVVGPSVVAVPLP

SEQ ID NO: 446 - protein, 16 aa, Mus sp.
TPESFLGPNAALVDLD

SEQ ID NO: 447 - protein, 17 aa, Mus sp.
YPNSFSAPEQQRSALEH

SEQ ID NO: 448 - protein, 13 aa, Mus sp.
LMLYTRKFESTDP

SEQ ID NO: 449 - protein, 17 aa, Mus sp.
SADDFFQGTKAALAGGT

SEQ ID NO: 450 - protein, 19 aa, Mus sp.
SPPPYAAYATPTPEVYGYG

SEQ ID NO: 451 - protein, 15 aa, Mus sp.
GKFIYITPEELAAVA

SEQ ID NO: 452 - protein, 18 aa, Mus sp.
RPGLSYHYAHSHLAEEEG

SEQ ID NO: 453 - protein, 27 aa, Mus sp.
VPPAGGGDPEAPAPAPAAERPPAPGPG

SEQ ID NO: 454 - protein, 16 aa, Mus sp.
QIPKVVKSPSSLPAKP

SEQ ID NO: 455 - protein, 16 aa, Mus sp.
KSFVQNYPVVSIEDPF

SEQ ID NO: 456 - protein, 17 aa, Mus sp.
LPKEELYMPPLVIKVID

SEQ ID NO: 457 - protein, 15 aa, Mus sp.
FYLALPPTVYEAVTK

SEQ ID NO: 458 - protein, 11 aa, Mus sp.
TLVTYVPVTTF

SEQ ID NO: 459 - protein, 14 aa, Mus sp.
DKFWGPSGAESVIG

SEQ ID NO: 460 - protein, 15 aa, Mus sp.
VKELFTTPVLRASVS

SEQ ID NO: 461 - protein, 17 aa, Mus sp.
DTIEFRGPNGLLVYQGK

SEQ ID NO: 462 - protein, 19 aa, Mus sp.
EDPDGFSWPATLPSVYKQP

SEQ ID NO: 463 - protein, 9 aa, Mus sp.
YMIDNIILL

SEQ ID NO: 464 - protein, 16 aa, Mus sp.
ARDNMFSGSKINYTEN

SEQ ID NO: 465 - protein, 9 aa, Mus sp.
YIAPEILQG

SEQ ID NO: 466 - protein, 14 aa, Mus sp.
WKALYTDPKSSETA

SEQ ID NO: 467 - protein, 16 aa, Mus sp.
APTTAYKKTTPIEAAS

SEQ ID NO: 468 - protein, 16 aa, Mus sp.
TIQWWNMPSPNVDPYD

SEQ ID NO: 469 - protein, 17 aa, Mus sp.
LDLLDLAPEPRYAHIPV

SEQ ID NO: 470 - protein, 15 aa, Mus sp.
AYWEVKYPFPLSNRD

SEQ ID NO: 471 - protein, 17 aa, Mus sp.
IAGVVYKDGIVLGADTR

SEQ ID NO: 472 - protein, 15 aa, Mus sp.
SKQEYDESGPSIVHR

SEQ ID NO: 473 - protein, 22 aa, Mus sp.
GPNIGGDTHFDSAEPWTVQNED

SEQ ID NO: 474 - protein, 15 aa, Mus sp.
SPYAFNGGTVLAIAG

SEQ ID NO: 475 - protein, 22 aa, Mus sp.
APETRSQVTPSVPSEALDDSTG

SEQ ID NO: 476 - protein, 16 aa, Mus sp.
ENPIYKSAVTTVVNPK

SEQ ID NO: 477 - protein, 15 aa, Mus sp.
LSLLYKVPYVAQEIQ

SEQ ID NO: 478 - protein, 23 aa, Mus sp.
PGPNIGGDTHFDSAEPWTVQNED

SEQ ID NO: 479 - protein, 21 aa, Mus sp.
RPDAFAISYVAALPAAALWHK

SEQ ID NO: 480 - protein, 17 aa, Mus sp.
YPFDFQGAKIITGQEEG

SEQ ID NO: 481 - protein, 16 aa, Mus sp.
NVTELNEPLSNEERNL

SEQ ID NO: 482 - protein, 17 aa, Mus sp.
YLPETFRRPQIDPAVEG

SEQ ID NO: 483 - protein, 15 aa, Mus sp.
EVEFSAPYPMEVIFE

SEQ ID NO: 484 - protein, 18 aa, Mus sp.
IARQNFTEPTAIQAQGWP

SEQ ID NO: 485 - protein, 11 aa, Mus sp.
DGDSYRSPWSN

SEQ ID NO: 486 - protein, 15 aa, Mus sp.
VFDVTAPNTFKTLDS

SEQ ID NO: 487 - protein, 15 aa, Mus sp.
EVQWQSAEPGSTPRK

SEQ ID NO: 488 - protein, 12 aa, Mus sp.
VTYVPVTTFKNL

SEQ ID NO: 489 - protein, 15 aa, Mus sp.
SPTGNIFFSPFSISS

SEQ ID NO: 490 - protein, 22 aa, Mus sp.
KPTVTVVSPLPNDSINPQPSPD

SEQ ID NO: 491 - protein, 15 aa, Mus sp.
LPNVQVEGPTPNRPR

SEQ ID NO: 492 - protein, 15 aa, Mus sp.
KLLEAKGPVTDVAYS

SEQ ID NO: 493 - protein, 22 aa, Mus sp.
GVEAARDNMFSGSKINYTENRA

SEQ ID NO: 494 - protein, 17 aa, Mus sp.
KNVTELNEPLSNEERNL

SEQ ID NO: 495 - protein, 23 aa, Listeria monocytogenes
AVDDTTVKFTLPTVAPAFENTIK

SEQ ID NO: 496 - protein, 18 aa, Mus sp.
GIDPYDQPNAIYIERHEP

SEQ ID NO: 497 - protein, 12 aa, Mus sp.
EFIWPAVQSSAL

SEQ ID NO: 498 - protein, 13 aa, Mus sp.
APDMVYLGSMTNF

SEQ ID NO: 499 - protein, 16 aa, Mus sp.
LQSTDYGNFLANEASP

SEQ ID NO: 500 - protein, 15 aa, Mus sp.
NPLNSVFVAPAVTPV

SEQ ID NO: 501 - protein, 18 aa, Mus sp.
SPVSETVVTPEAAPEKNP

SEQ ID NO: 502 - protein, 14 aa, Mus sp.
APQGSLGEYLFERL

SEQ ID NO: 503 - protein, 16 aa, Mus sp.
ITDKFWGPSGAESVIG

SEQ ID NO: 504 - protein, 20 aa, Mus sp.
EGKLLEAKGPVTDVAYSHDG

SEQ ID NO: 505 - protein, 16 aa, Mus sp.
FELPYVSVTSLRSQEY

SEQ ID NO: 506 - protein, 15 aa, Mus sp.
IEEIEVAPPKAHEVR

SEQ ID NO: 507 - protein, 17 aa, Mus sp.
IESKEAFQEALAAAGDK

SEQ ID NO: 508 - protein, 20 aa, Mus sp.
LPPYDDATAVPSTAKEPPPP

SEQ ID NO: 509 - protein, 21 aa, Mus sp.
LVVSNITRLIDLPGTELAQLM

SEQ ID NO: 510 - protein, 15 aa, Mus sp.
GQNAWFLPAQADIVA

SEQ ID NO: 511 - protein, 18 aa, Mus sp.
NPTLDHYKEPSAIFQLPY

SEQ ID NO: 512 - protein, 12 aa, Mus sp.
VLAPQVVLSLGG

SEQ ID NO: 513 - protein, 18 aa, Mus sp.
LDIYVWRGAQATLSNTTK

SEQ ID NO: 514 - protein, 16 aa, Mus sp.
TVIHFNNPKVQASLSA

SEQ ID NO: 515 - protein, 17 aa, Mus sp.
TPDPNTAYASYPSASVE

SEQ ID NO: 516 - protein, 18 aa, Listeria monocytogenes
VDDTTVKFTLPTVAPAFE

SEQ ID NO: 517 - protein, 21 aa, Mus sp.
GTPEYIAPEVIFRQGYGKPVD

SEQ ID NO: 518 - protein, 22 aa, Mus sp.
LPEEVGEYRQPSGGSVPVSPGP

SEQ ID NO: 519 - protein, 15 aa, Mus sp.
GVLLPFFDPDTNIVY

SEQ ID NO: 520 - protein, 10 aa, Mus sp.
FVAPAVTPVK

SEQ ID NO: 521 - protein, 17 aa, Mus sp.
AANVYTTVVAELVRGGQ

SEQ ID NO: 522 - protein, 19 aa, Mus sp.
EKPVPAAPVPSPVAPAPVP

SEQ ID NO: 523 - protein, 12 aa, Mus sp.
YNPPIIHQGFQD

SEQ ID NO: 524 - protein, 18 aa, Mus sp.
SGPKPFSAPKPQTSPSPK

SEQ ID NO: 525 - protein, 19 aa, Mus sp.
YNIPFTEKNILYSAFLWRT

SEQ ID NO: 526 - protein, 15 aa, Mus sp.
NQLEALVGPEANVGP

SEQ ID NO: 527 - protein, 17 aa, Mus sp.
ENLYPYLGPSTLRDRPQ

SEQ ID NO: 528 - protein, 14 aa, Mus sp.
ITTDYNSPEAGNIF

SEQ ID NO: 529 - protein, 25 aa, Mus sp.
LPNKPTVTVVSPLPNDSINPQPSPD

SEQ ID NO: 530 - protein, 20 aa, Mus sp.
DSVTTDHISPAGNIARNSPA

SEQ ID NO: 531 - protein, 15 aa, Mus sp.
ENDIYNFFSPLNPVR

SEQ ID NO: 532 - protein, 20 aa, Mus sp.
DDGTVIHFNNPKVQASLSAN

SEQ ID NO: 533 - protein, 15 aa, Mus sp.
VAWATGEPNFANDDE

SEQ ID NO: 534 - protein, 8 aa, Mus sp.
AVYSFEAL

SEQ ID NO: 535 - protein, 18 aa, Mus sp.
GQDHVDFSQPEPHTVLFH

SEQ ID NO: 536 - protein, 17 aa, BOVIN
GPPVASVVVGPSVVAVP

SEQ ID NO: 537 - protein, 14 aa, Mus sp.
TAYASYPSASVENY

SEQ ID NO: 538 - protein, 27 aa, Mus sp.
GDQGRDGIPGPPGEKGETGLLGAYPGP

SEQ ID NO: 539 - protein, 12 aa, Mus sp.
IEVSSPITLQAL

SEQ ID NO: 540 - protein, 14 aa, Mus sp.
KDGYQMAQPVFAPK

SEQ ID NO: 541 - protein, 18 aa, Mus sp.
RDGDSYRSPWSNKYDPPL

SEQ ID NO: 542 - protein, 19 aa, Mus sp.
RAKQIVWNGPVGVFEWEAF

SEQ ID NO: 543 - protein, 15 aa, Mus sp.
SFVDYQTTMVRTAKA

SEQ ID NO: 544 - protein, 15 aa, Listeria monocytogenes
YMEKHSVSRLVGAPP

SEQ ID NO: 545 - protein, 20 aa, Mus sp.
VGAGHFRSPHTTEVVGGAPQ

SEQ ID NO: 546 - protein, 16 aa, Mus sp.
PNENCLKQIAVSSVPS

SEQ ID NO: 547 - protein, 18 aa, Mus sp.
DLGSDIFAAPAPQSTATA

SEQ ID NO: 548 - protein, 16 aa, Mus sp.
QDPTFHTPLDLYAYAR

SEQ ID NO: 549 - protein, 16 aa, Mus sp.
VKFKSFCLKHSQNKPK

SEQ ID NO: 550 - protein, 17 aa, Mus sp.
VLDNYLTSPLPEEVDET

SEQ ID NO: 551 - protein, 13 aa, Mus sp.
EVYTFPVPERHLE

SEQ ID NO: 552 - protein, 16 aa, Mus sp.
LSLLYNVPAVAEEIQD

SEQ ID NO: 553 - protein, 16 aa, Mus sp.
IMFETFNTPAMYVAIQ

SEQ ID NO: 554 - protein, 25 aa, Mus sp.
NVDPFKAVDTNRASMGQASPESKGF

SEQ ID NO: 555 - protein, 16 aa, Mus sp.
QNAWFLPAQADIVATK

SEQ ID NO: 556 - protein, 16 aa, Mus sp.
FKKWVNTPFTASSIEL

SEQ ID NO: 557 - protein, 17 aa, Mus sp.
LSSEMNTSTVNSAREEL

SEQ ID NO: 558 - protein, 15 aa, Mus sp.
HPIQWNAPEPSHITK

SEQ ID NO: 559 - protein, 28 aa, Mus sp.
EDDIEADHVGTYGISVYQSPGDIGQYTF

SEQ ID NO: 560 - protein, 15 aa, Mus sp.
GSLFLKTPKIVSSKD

SEQ ID NO: 561 - protein, 15 aa, Mus sp.
PDGFSWPATLPSVYK

SEQ ID NO: 562 - protein, 15 aa, Mus sp.
GGERFEAPEALFQPH

SEQ ID NO: 563 - protein, 19 aa, Mus sp.
SPPPGGYGQPSVLPGGYPA

SEQ ID NO: 564 - protein, 14 aa, Mus sp.
LPDYSAPNPIKVTH

SEQ ID NO: 565 - protein, 16 aa, Mus sp.
SVTYYGPSGQKTIYSE

SEQ ID NO: 566 - protein, 15 aa, Mus sp.
SSPYNPPDLEEAAKT

SEQ ID NO: 567 - protein, 16 aa, Mus sp.
EAIETIVAAMSNLVPP

SEQ ID NO: 568 - protein, 14 aa, Mus sp.
KFPDWSFPSAWVST

SEQ ID NO: 569 - protein, 16 aa, Mus sp.
SYPFDFQGAKIITGQE

SEQ ID NO: 570 - protein, 18 aa, Mus sp.
LQHGSLFLKTPKIVSSKD

SEQ ID NO: 571 - protein, 16 aa, Mus sp.
LPFGAYTNPFATPAQA

SEQ ID NO: 572 - protein, 16 aa, Mus sp.
AAYLWVGAGASEAEKT

SEQ ID NO: 573 - protein, 16 aa, Mus sp.
SALVWLSPSVLVSGAE

SEQ ID NO: 574 - protein, 21 aa, Mus sp.
LDPAGPNFEYAEAPSRLSPDD

SEQ ID NO: 575 - protein, 17 aa, Mus sp.
LKYHFVTPLTSMVVTKP

SEQ ID NO: 576 - protein, 18 aa, Mus sp.
APAPEFTAAQPEVADWSE

SEQ ID NO: 577 - protein, 18 aa, Mus sp.
MLDENNHLIQCIMDYQNK

SEQ ID NO: 578 - protein, 17 aa, Mus sp.
GGSPYIAAKINEAKDLL

SEQ ID NO: 579 - protein, 16 aa, Mus sp.
WKFTITPPSAQVVGVL

SEQ ID NO: 580 - protein, 12 aa, Mus sp.
VGGERFEAPEAL

SEQ ID NO: 581 - protein, 28 aa, Mus sp.
MQNLGMTSPLPFDSLGYNASHHPFAGYP

SEQ ID NO: 582 - protein, 13 aa, Mus sp.
IQEPYTFPAILKS

SEQ ID NO: 583 - protein, 18 aa, Mus sp.
DPDSRGEYSWAVAQGVKQ

SEQ ID NO: 584 - protein, 13 aa, Mus sp.
DLLYSFPVVIKNK

SEQ ID NO: 585 - protein, 15 aa, Mus sp.
SALEYGMPVTLIGEA

SEQ ID NO: 586 - protein, 16 aa, Mus sp.
FSFGKINPHYTVKGLE

SEQ ID NO: 587 - protein, 16 aa, Mus sp.
TIEFRGPNGLLVYQGK

SEQ ID NO: 588 - protein, 15 aa, Mus sp.
KPSGYNPPISILGIL

SEQ ID NO: 589 - protein, 12 aa, Mus sp.
FRVPTPNVSVVD

SEQ ID NO: 590 - protein, 16 aa, Mus sp.
DNMFSGSKINYTENRA

SEQ ID NO: 591 - protein, 34 aa, Listeria monocytogenes
DGLKAGEHFFAAGKDWPDAIYANGDEVAAGVMYH

SEQ ID NO: 592 - protein, 16 aa, Mus sp.
AQPATAPQAAAAQEPG

SEQ ID NO: 593 - protein, 16 aa, Mus sp.
SVGAWTGPMGNWAMFT

SEQ ID NO: 594 - protein, 17 aa, Mus sp.
WQPLTWTSSQPSGITVE

SEQ ID NO: 595 - protein, 17 aa, Mus sp.
ESPDQWSSSSPHSASDW

SEQ ID NO: 596 - protein, 21 aa, Mus sp.
DPAGPNFEYAEAPSRLSPDDA

SEQ ID NO: 597 - protein, 16 aa, Mus sp.
SALEYGMPVTLIGEAV

SEQ ID NO: 598 - protein, 15 aa, Mus sp.
LPPVSPPKAALSVDE

SEQ ID NO: 599 - protein, 15 aa, Mus sp.
TTVSLSAPDALKIIT

SEQ ID NO: 600 - protein, 18 aa, Mus sp.
VPAQSTFWRPQTQEERPH

SEQ ID NO: 601 - protein, 12 aa, Mus sp.
EEAESFADMMKH

SEQ ID NO: 602 - protein, 18 aa, Mus sp.
DGDMRLVNGASANEGRVE

SEQ ID NO: 603 - protein, 16 aa, Mus sp.
GYGPYSGAYPAGTQVV

SEQ ID NO: 604 - protein, 16 aa, Mus sp.
GNHTLFHNPHVNPLPT

SEQ ID NO: 605 - protein, 17 aa, Mus sp.
SLESFLGPRANTEDLPF

SEQ ID NO: 606 - protein, 16 aa, Mus sp.
VMRIINEPTAAAIAYG

SEQ ID NO: 607 - protein, 16 aa, Mus sp.
DVQLVESGGGLVQPGG

SEQ ID NO: 608 - protein, 19 aa, Mus sp.
ENHIEVWERPLSNLAWAVA

SEQ ID NO: 609 - protein, 21 aa, Mus sp.
HPDKGGSPYIAAKINEAKDLL

SEQ ID NO: 610 - protein, 13 aa, Mus sp.
GYVPSQADVAVFE

SEQ ID NO: 611 - protein, 16 aa, Mus sp.
KFIYVDVLPEEAVGPV

SEQ ID NO: 612 - protein, 15 aa, Mus sp.
GYAVYETPTAHNGAK

SEQ ID NO: 613 - protein, 19 aa, Mus sp.
SPPGGDFSDPVTSATLGIV

SEQ ID NO: 614 - protein, 14 aa, Mus sp.
GVELYRAPFPLYAL

SEQ ID NO: 615 - protein, 11 aa, Mus sp.
FVAPAVTPVKG

SEQ ID NO: 616 - protein, 27 aa, Mus sp.
VIPELNGKLTGMAFRVPTPNVSVVDLT

SEQ ID NO: 617 - protein, 20 aa, Mus sp.
APWDPQLSYAVSWAKVSESG

SEQ ID NO: 618 - protein, 15 aa, Mus sp.
AVDVFFPPEAQNDFP

SEQ ID NO: 619 - protein, 18 aa, Mus sp.
APGGYPAAGPYGVPAGPL

SEQ ID NO: 620 - protein, 14 aa, Mus sp.
APGGYVAPKAVWLP

SEQ ID NO: 621 - protein, 17 aa, Mus sp.
LDIYVWRGAQATLSNTT

SEQ ID NO: 622 - protein, 14 aa, Mus sp.
LEDFYGSPIPSVSL

SEQ ID NO: 623 - protein, 16 aa, Mus sp.
ASLELLEGKVLPGVDA

SEQ ID NO: 624 - protein, 16 aa, Mus sp.
FGTGHSAPSASPAFGA

SEQ ID NO: 625 - protein, 23 aa, Mus sp.
DKNGNPLNSVFVAPAVTPVKGVL

SEQ ID NO: 626 - protein, 14 aa, Mus sp.
DLLYSFPVVIKNKT

SEQ ID NO: 627 - protein, 15 aa, Mus sp.
VQLVEYEASAAGLIR

SEQ ID NO: 628 - protein, 19 aa, Mus sp.
NPGNPHNVYMPTSQPPPPP

SEQ ID NO: 629 - protein, 13 aa, Mus sp.
DAFVLKTPSAAYL

SEQ ID NO: 630 - protein, 20 aa, Mus sp.
YPRDISNYGFPRSVQAIDAA

SEQ ID NO: 631 - protein, 16 aa, Mus sp.
GYAVYETPTAHNGAKN

SEQ ID NO: 632 - protein, 18 aa, Mus sp.
HNNILVSSMLESPINSLY

SEQ ID NO: 633 - protein, 16 aa, Mus sp.
EQFSYVLPTVHSLEPS

SEQ ID NO: 634 - protein, 17 aa, Mus sp.
SLEDFYGSPIPSVSLKL

SEQ ID NO: 635 - protein, 17 aa, Mus sp.
ADPSAFAAAAPAAAATT

SEQ ID NO: 636 - protein, 16 aa, Mus sp.
KWKALYTDPKSSETAA

SEQ ID NO: 637 - protein, 15 aa, Mus sp.
SMFLHINETYLLMEQ

SEQ ID NO: 638 - protein, 16 aa, Mus sp.
RVSSWDVPTVVPVPFE

SEQ ID NO: 639 - protein, 17 aa, Mus sp.
IPPTHYAASRAASVAEN

SEQ ID NO: 640 - protein, 17 aa, Mus sp.
EDGELTYENVQVSPVPG

SEQ ID NO: 641 - protein, 17 aa, Mus sp.
DPELPQFIQAKVNAINM

SEQ ID NO: 642 - protein, 14 aa, Mus sp.
VIYTHPEVAWVGKS

SEQ ID NO: 643 - protein, 19 aa, Mus sp.
LPQEKYVTSAPMPEPGAPG

SEQ ID NO: 644 - protein, 27 aa, Mus sp.
FPGPNIGGDTHFDSAEPWTVQNEDLNG

SEQ ID NO: 645 - protein, 20 aa, Mus sp.
YTWSDAAAPFAGLSTDQTLR

SEQ ID NO: 646 - protein, 17 aa, Mus sp.
DLPNSFDGPVTITIVNR

SEQ ID NO: 647 - protein, 15 aa, Mus sp.
FRLWDFRDPSIHSVN

SEQ ID NO: 648 - protein, 18 aa, Mus sp.
LNVMRIINEPTAAAIAYG

SEQ ID NO: 649 - protein, 16 aa, Mus sp.
AIETIVAAMSNLVPPV

SEQ ID NO: 650 - protein, 16 aa, Mus sp.
VADKEFHAPLIIDENG

SEQ ID NO: 651 - protein, 15 aa, Mus sp.
HTLFHNPHVNPLPTG

SEQ ID NO: 652 - protein, 14 aa, Mus sp.
RRYNPPIIHQGFQD

SEQ ID NO: 653 - protein, 16 aa, Mus sp.
GQNAWFLPAQADIVAT

SEQ ID NO: 654 - protein, 15 aa, Mus sp.
VTQFHPPHIEIQMLK

SEQ ID NO: 655 - protein, 14 aa, Mus sp.
DGDSYRSPWSNKYD

SEQ ID NO: 656 - protein, 17 aa, Mus sp.
EQLPNVQVEGPTPNRPR

SEQ ID NO: 657 - protein, 19 aa, Mus sp.
TDDEKVRVSYYGPKTSPVQ

SEQ ID NO: 658 - protein, 16 aa, Mus sp.
ATEEKYHEALAKGDVT

SEQ ID NO: 659 - protein, 15 aa, Mus sp.
GPKPFSAPKPQTSPS

SEQ ID NO: 660 - protein, 15 aa, Mus sp.
DVPFTLAPHVLAAQG

SEQ ID NO: 661 - protein, 16 aa, Mus sp.
KKFRFEEPVVLPDLSD

SEQ ID NO: 662 - protein, 12 aa, Mus sp.
VFFPPEAQNDFP

SEQ ID NO: 663 - protein, 16 aa, Mus sp.
APGGYVAPKAVWLPAV

SEQ ID NO: 664 - protein, 17 aa, Mus sp.
YTWSDAAAPFAGLSTDQ

SEQ ID NO: 665 - protein, 17 aa, Mus sp.
ASVATNPIITPVAQENQ

SEQ ID NO: 666 - protein, 19 aa, Mus sp.
HPPQEATNSPKPQPSYEEL

SEQ ID NO: 667 - protein, 11 aa, Mus sp.
HDLDFRAPHVL

SEQ ID NO: 668 - protein, 18 aa, Mus sp.
DGLNLDWQYPGSRGSPPK

SEQ ID NO: 669 - protein, 20 aa, Mus sp.
LPDDINVYATTAANPKESSY

SEQ ID NO: 670 - protein, 21 aa, Mus sp.
WGIDPYDQPNAIYIERHEPFG

SEQ ID NO: 671 - protein, 17 aa, Mus sp.
SEERVYMVGKANSVFED

SEQ ID NO: 672 - protein, 15 aa, Mus sp.
TTSSYSNPTIGYENR

SEQ ID NO: 673 - protein, 18 aa, Mus sp.
DVVDRVLKSPVASIVYEL

SEQ ID NO: 674 - protein, 19 aa, Mus sp.
IGGDTHFDSAEPWTVQNED

SEQ ID NO: 675 - protein, 16 aa, Mus sp.
QGGVYASPSIAGSRPG

SEQ ID NO: 676 - protein, 14 aa, Mus sp.
YDPIISPEVAASFG

SEQ ID NO: 677 - protein, 16 aa, Mus sp.
EEEEVEVFLPKFKLEE

SEQ ID NO: 678 - protein, 22 aa, Mus sp.
GPDGKGMNPPSYYTQPVPVPNA

SEQ ID NO: 679 - protein, 14 aa, Mus sp.
FFWNVAPGAESAVA

SEQ ID NO: 680 - protein, 11 aa, Mus sp.
DIEADHVGTYG

SEQ ID NO: 681 - protein, 15 aa, Mus sp.
TPAYTIPFYTPIPNG

SEQ ID NO: 682 - protein, 14 aa, Mus sp.
EDRRYNPPIIHQGF

SEQ ID NO: 683 - protein, 14 aa, Mus sp.
VEFSAPYPMEVIFE

SEQ ID NO: 684 - protein, 15 aa, Mus sp.
AVDALASSHPLSSPA

SEQ ID NO: 685 - protein, 16 aa, Mus sp.
LPHFLHASPDVSEPIE

SEQ ID NO: 686 - protein, 18 aa, Mus sp.
LPKPIIWAEPGSVIAAYT

SEQ ID NO: 687 - protein, 15 aa, Mus sp.
TNTAYVGSAILSEET

SEQ ID NO: 688 - protein, 17 aa, Mus sp.
ITPSYYTTSDAVISTET

SEQ ID NO: 689 - protein, 16 aa, Mus sp.
EFSFWNEPVPRPGPNI

SEQ ID NO: 690 - protein, 14 aa, Mus sp.
GDIEHPRAIALDPR

SEQ ID NO: 691 - protein, 17 aa, Mus sp.
IASFKDPKISTSLPVLD

SEQ ID NO: 692 - protein, 16 aa, Mus sp.
VKSKYKASIAALEAKI

SEQ ID NO: 693 - protein, 23 aa, Mus sp.
NPEPPPPRSHYSNIEANESEEVR

SEQ ID NO: 694 - protein, 15 aa, Mus sp.
YDVYRYLPPATQVVL

SEQ ID NO: 695 - protein, 17 aa, Listeria monocytogenes
DDTTVKFTLPTVAPAFE

SEQ ID NO: 696 - protein, 19 aa, Mus sp.
MEKEDRRYNPPIIHQGFQD

SEQ ID NO: 697 - protein, 20 aa, Mus sp.
DVVDRVLKSPVASIVYELNP

SEQ ID NO: 698 - protein, 12 aa, Mus sp.
TNPIITPVAQEN

SEQ ID NO: 699 - protein, 15 aa, Mus sp.
SKIRYKTSEPVWEEN

SEQ ID NO: 700 - protein, 22 aa, Mus sp.
DESGFPKPPSYNVATTLPSYDE

SEQ ID NO: 701 - protein, 18 aa, Mus sp.
AGPQWADPQISESNFSPK

SEQ ID NO: 702 - protein, 15 aa, Mus sp.
QNAWFLPAQADIVAT

SEQ ID NO: 703 - protein, 16 aa, Mus sp.
TRSQVTPSVPSEALDD

SEQ ID NO: 704 - protein, 14 aa, Mus sp.
TPDIIINPHAIPSR

SEQ ID NO: 705 - protein, 17 aa, Mus sp.
LSLLYNVPAVAEEIQDE

SEQ ID NO: 706 - protein, 15 aa, Mus sp.
ISKQEYDESGPSIVH

SEQ ID NO: 707 - protein, 15 aa, Mus sp.
KPSTFAYPAPLEVPK

SEQ ID NO: 708 - protein, 17 aa, Mus sp.
APMYYRGAQAAIVVYDI

SEQ ID NO: 709 - protein, 15 aa, Mus sp.
IDWREPEGKEVWDYV

SEQ ID NO: 710 - protein, 15 aa, Mus sp.
LQQEFQRAQAAKAPG

SEQ ID NO: 711 - protein, 13 aa, Mus sp.
SVSYLRECAKAND

SEQ ID NO: 712 - protein, 11 aa, Mus sp.
SVFVAPAVTPV

SEQ ID NO: 713 - protein, 11 aa, Mus sp.
GIYTYGKPVPG

SEQ ID NO: 714 - protein, 18 aa, Mus sp.
TEQTYWQATPFRAVAEPG

SEQ ID NO: 715 - protein, 18 aa, Mus sp.
LAPMYYRGAQAAIVVYDI

SEQ ID NO: 716 - protein, 20 aa, Mus sp.
GQDHVDFSQPEPHTVLFHEP

SEQ ID NO: 717 - protein, 17 aa, Mus sp.
FPTDYPFKPPKVAFTTR

SEQ ID NO: 718 - protein, 20 aa, Mus sp.
IGDSNFGAPSASVAAAPAPA

SEQ ID NO: 719 - protein, 17 aa, Mus sp.
EDNVFEAPTLVKVFKQP

SEQ ID NO: 720 - protein, 13 aa, Mus sp.
EVAFNGPKGGYVA

SEQ ID NO: 721 - protein, 16 aa, Mus sp.
DQENKYQASHPNLRRL

SEQ ID NO: 722 - protein, 21 aa, Mus sp.
GPHSMRYFETAVSRPGLEEPR

SEQ ID NO: 723 - protein, 14 aa, Mus sp.
FQINQDEEEEEDED

SEQ ID NO: 724 - protein, 16 aa, Mus sp.
SPTGNIFFSPFSISSA

SEQ ID NO: 725 - protein, 14 aa, Mus sp.
IVYWMTSQPSDAVR

SEQ ID NO: 726 - protein, 17 aa, Mus sp.
HGLELEEPPLVLAAANV

SEQ ID NO: 727 - protein, 18 aa, Mus sp.
EPPSDLDFFSPRPVPAAS

SEQ ID NO: 728 - protein, 14 aa, Mus sp.
EDNWSLPNRAVEPQ

SEQ ID NO: 729 - protein, 19 aa, Mus sp.
SGPKPFSAPKPQTSPSPKP

SEQ ID NO: 730 - protein, 15 aa, Mus sp.
LLLHWQPPLSHNGVL

SEQ ID NO: 731 - protein, 15 aa, Mus sp.
DTAAKFIGAGAATVG

SEQ ID NO: 732 - protein, 15 aa, Mus sp.
TVIHFNNPKVQASLS

SEQ ID NO: 733 - protein, 16 aa, Mus sp.
GFLSEIGSQALAAGSY

SEQ ID NO: 734 - protein, 14 aa, Mus sp.
EPVWRSEQAIGAIA

SEQ ID NO: 735 - protein, 13 aa, Mus sp.
RYMAPEVLDEHIR

SEQ ID NO: 736 - protein, 16 aa, Mus sp.
KNVTELNEPLSNEERN

SEQ ID NO: 737 - protein, 16 aa, Mus sp.
ITPSYVAFTPEGERLI

SEQ ID NO: 738 - protein, 18 aa, Mus sp.
TGVPTVPLLPPQVNQSLA

SEQ ID NO: 739 - protein, 15 aa, Mus sp.
TAQYKCPVAMEEADD

SEQ ID NO: 740 - protein, 16 aa, Mus sp.
EDYVELPPSVSQAAKS

SEQ ID NO: 741 - protein, 11 aa, Mus sp.
QVTQPTVGMNF

SEQ ID NO: 742 - protein, 14 aa, Mus sp.
AIVEYHGPGVDSIS

SEQ ID NO: 743 - protein, 17 aa, Mus sp.
VPYPRIHFPLATYAPVI

SEQ ID NO: 744 - protein, 20 aa, Mus sp.
YNRDGDSYRSPWSNKYDPPL

SEQ ID NO: 745 - protein, 18 aa, Mus sp.
NPTDEYLDAMMNEAPGPI

SEQ ID NO: 746 - protein, 16 aa, Mus sp.
MPDMHFKTPKISMPDV

SEQ ID NO: 747 - protein, 16 aa, Mus sp.
ITNQYNSPTGLYSSEN

SEQ ID NO: 748 - protein, 14 aa, Mus sp.
TIPFYTPIPNGLYP

SEQ ID NO: 749 - protein, 13 aa, Mus sp.
TSSYSNPTIGYEN

SEQ ID NO: 750 - protein, 18 aa, Mus sp.
LEDPDGFSWPATLPSVYK

SEQ ID NO: 751 - protein, 15 aa, Mus sp.
AFPFESGKPFKIQVL

SEQ ID NO: 752 - protein, 16 aa, Mus sp.
KNLDYVATSIHEAVTK

SEQ ID NO: 753 - protein, 19 aa, Mus sp.
KPTVTVVSPLPNDSINPQP

SEQ ID NO: 754 - protein, 15 aa, Mus sp.
RAGYKAAIVHNVDSD

SEQ ID NO: 755 - protein, 16 aa, Mus sp.
GMAFRVPTPNVSVVDL

SEQ ID NO: 756 - protein, 9 aa, Mus sp.
ELFPVFTQL

SEQ ID NO: 757 - protein, 21 aa, Mus sp.
APSEERVYMVGKANSVFEDLS

SEQ ID NO: 758 - protein, 18 aa, Mus sp.
LNVLRVINEPTAAALAYG

SEQ ID NO: 759 - protein, 14 aa, Mus sp.
RDKWLAPDGLIFPD

SEQ ID NO: 760 - protein, 17 aa, Mus sp.
YAVDIRSPAISWVNNLE

SEQ ID NO: 761 - protein, 15 aa, Mus sp.
TPATNEAPQATVFPK

SEQ ID NO: 762 - protein, 18 aa, Mus sp.
FKKWVNTPFTASSIELVP

SEQ ID NO: 763 - protein, 16 aa, Mus sp.
KPIIWAEPGSVIAAYT

SEQ ID NO: 764 - protein, 18 aa, Mus sp.
SAVKSKYKASIAALEAKI

SEQ ID NO: 765 - protein, 16 aa, Mus sp.
LPNSFDGPVTITIVNR

SEQ ID NO: 766 - protein, 13 aa, Mus sp.
KFRFEEPVVLPDL

SEQ ID NO: 767 - protein, 14 aa, Mus sp.
EPSVFNGPEVTMLK

SEQ ID NO: 768 - protein, 16 aa, Mus sp.
GIYEYYEPRLSVLPSP

SEQ ID NO: 769 - protein, 16 aa, Mus sp.
VKQYYEVPIAMKSVFD

SEQ ID NO: 770 - protein, 13 aa, Mus sp.
LSYREPDPEDAVG

SEQ ID NO: 771 - protein, 12 aa, Mus sp.
EAGAFNAPVINR

SEQ ID NO: 772 - protein, 18 aa, Mus sp.
VQIPKVVKSPSSLPAKPL

SEQ ID NO: 773 - protein, 16 aa, Mus sp.
LGEFDTPEAIWSSEMR

SEQ ID NO: 774 - protein, 18 aa, Mus sp.
ESLHLRFSAPQIENEPET

SEQ ID NO: 775 - protein, 24 aa, Mus sp.
TPARAPETRSQVTPSVPSEALDDS

SEQ ID NO: 776 - protein, 19 aa, Mus sp.
NFKKWVNTPFTASSIELVP

SEQ ID NO: 777 - protein, 15 aa, Mus sp.
GDFYYHAAIFGGTPT

SEQ ID NO: 778 - protein, 14 aa, Mus sp.
GPTYRGPVPWHTIN

SEQ ID NO: 779 - protein, 15 aa, Mus sp.
VIHFNNPKVQASLAA

SEQ ID NO: 780 - protein, 19 aa, Mus sp.
NPTDAYLDAMMNEAPGPIN

SEQ ID NO: 781 - protein, 15 aa, Mus sp.
LRDMYSKSSAAMSTY

SEQ ID NO: 782 - protein, 16 aa, Mus sp.
TVIHFNNPKVQASLAA

SEQ ID NO: 783 - protein, 26 aa, Mus sp.
NPTVEVDLYTAKGLFRAAVPSGASTG

SEQ ID NO: 784 - protein, 16 aa, Mus sp.
AEIEYAMAYSKAAFER

SEQ ID NO: 785 - protein, 12 aa, Mus sp.
VDFIGSTVGLAK

SEQ ID NO: 786 - protein, 15 aa, Mus sp.
DLLYSFPVVIKNKTW

SEQ ID NO: 787 - protein, 15 aa, Mus sp.
GRPDAEYWNSQPEIL

SEQ ID NO: 788 - protein, 14 aa, Mus sp.
LPPYDDATAVPSTA

SEQ ID NO: 789 - protein, 17 aa, Mus sp.
DLGSDIFAAPAPQSTAT

SEQ ID NO: 790 - protein, 17 aa, Mus sp.
VGTKRYMAPEVLDDSIN

SEQ ID NO: 791 - protein, 15 aa, Mus sp.
SEVYHEPHIADAWPQ

SEQ ID NO: 792 - protein, 17 aa, Mus sp.
GENPIYKSAVTTVVNPK

SEQ ID NO: 793 - protein, 15 aa, Mus sp.
YEERVLPSIVNEVLK

SEQ ID NO: 794 - protein, 15 aa, Mus sp.
KRSNEFDYPSVGQLA

SEQ ID NO: 795 - protein, 14 aa, Mus sp.
VSFVQPNGAIFEPS

SEQ ID NO: 796 - protein, 12 aa, Mus sp.
GERFEAPEALFQ

SEQ ID NO: 797 - protein, 15 aa, Mus sp.
AINDYKGAVIVVSHD

SEQ ID NO: 798 - protein, 15 aa, Mus sp.
VNGKKFTAPHILIAT

SEQ ID NO: 799 - protein, 16 aa, Mus sp.
VPNYKLITPAVVSERL

SEQ ID NO: 800 - protein, 12 aa, Mus sp.
VGAWTGPMGNWA

SEQ ID NO: 801 - protein, 16 aa, Mus sp.
LPPHVYSTPQPSLPPV

SEQ ID NO: 802 - protein, 15 aa, Mus sp.
VTPWKAPIVWEGTYD

SEQ ID NO: 803 - protein, 18 aa, Mus sp.
RSFFWNVAPGAESAVASF

SEQ ID NO: 804 - protein, 26 aa, Mus sp.
FPGPNIGGDTHFDSAEPWTVQNEDLN

SEQ ID NO: 805 - protein, 18 aa, Mus sp.
APAPAPAAAPAPAPAAQA

SEQ ID NO: 806 - protein, 14 aa, Mus sp.
LRDNYRFAHTNIES

SEQ ID NO: 807 - protein, 16 aa, Mus sp.
QASIYSPPAAAAAAAA

SEQ ID NO: 808 - protein, 15 aa, Mus sp.
FGPYYTEPVIAGLDP

SEQ ID NO: 809 - protein, 16 aa, Mus sp.
ADEPVWRSEQAIGAIA

SEQ ID NO: 810 - protein, 16 aa, Mus sp.
HNKLYVLQWLTLFFDN

SEQ ID NO: 811 - protein, 17 aa, Mus sp.
MPDMHFKAPKISMPDVD

SEQ ID NO: 812 - protein, 16 aa, Mus sp.
SDPKPYSPKLSVIPTS

SEQ ID NO: 813 - protein, 16 aa, Mus sp.
HTSYYSESVVRESYIG

SEQ ID NO: 814 - protein, 7 aa, Mus sp.
SIASFKD

SEQ ID NO: 815 - protein, 15 aa, Mus sp.
SNLSYREPDPEDAVG

SEQ ID NO: 816 - protein, 18 aa, Mus sp.
GAEIEYAMAYSKAAFERE

SEQ ID NO: 817 - protein, 8 aa, Mus sp.
TIIIFHSL

SEQ ID NO: 818 - protein, 15 aa, Mus sp.
IDQYQGADAVGLEEK

SEQ ID NO: 819 - protein, 17 aa, Mus sp.
TPSSPSYSPSSPSYSPT

SEQ ID NO: 820 - protein, 14 aa, Mus sp.
ISNYGFPRSVQAID

SEQ ID NO: 821 - protein, 14 aa, Mus sp.
VTRQTTQYPEANAL

SEQ ID NO: 822 - protein, 27 aa, Mus sp.
SNDTTVLLPPYDDATAVPSTAKEPPPP

SEQ ID NO: 823 - protein, 14 aa, Mus sp.
LFPQYTAPSILPSD

SEQ ID NO: 824 - protein, 13 aa, Mus sp.
EEEKAPEVSPAQP

SEQ ID NO: 825 - protein, 16 aa, Mus sp.
TPVFVHAGPFANIAHG

SEQ ID NO: 826 - protein, 18 aa, Mus sp.
LADPSAFAAAAPAAAATT

SEQ ID NO: 827 - protein, 16 aa, Mus sp.
FPLATYAPVISAEKAY

SEQ ID NO: 828 - protein, 15 aa, Mus sp.
KPEDYQGGRTGEAIV

SEQ ID NO: 829 - protein, 19 aa, Mus sp.
TPSAAYLWVGAGASEAEKT

SEQ ID NO: 830 - protein, 12 aa, Mus sp.
VSYYGPKTSPVQ

SEQ ID NO: 831 - protein, 22 aa, Mus sp.
GPNDERFGVRFPAMSDAYDRDM

SEQ ID NO: 832 - protein, 17 aa, Mus sp.
SPGILQASPTPLLAAAA

SEQ ID NO: 833 - protein, 13 aa, Mus sp.
SFKDPKISTSLPV

SEQ ID NO: 834 - protein, 14 aa, Mus sp.
FTYQQPQPLSVEPR

SEQ ID NO: 835 - protein, 17 aa, Mus sp.
RDLKWGTPVPLEGFEDK

SEQ ID NO: 836 - protein, 15 aa, Mus sp.
KNNSFYGPEVKIEKG

SEQ ID NO: 837 - protein, 19 aa, Mus sp.
ITRDLKWGTPVPLEGFEDK

SEQ ID NO: 838 - protein, 15 aa, Mus sp.
GDLEYQMSTTARAKR

SEQ ID NO: 839 - protein, 15 aa, Mus sp.
KNVTELNEPLSNEER

SEQ ID NO: 840 - protein, 14 aa, Mus sp.
RPDAEYWNSQPEIL

SEQ ID NO: 841 - protein, 18 aa, Mus sp.
KLTGMAFRVPTPNVSVVD

SEQ ID NO: 842 - protein, 8 aa, Mus sp.
ASYEFTTL

SEQ ID NO: 843 - protein, 27 aa, Mus sp.
DDIEADHVGTYGISVYQSPGDIGQYTF

SEQ ID NO: 844 - protein, 14 aa, Mus sp.
VTYEWAPPVQNQAL

SEQ ID NO: 845 - protein, 16 aa, Mus sp.
SLLYNVPAVAEEIQDE

SEQ ID NO: 846 - protein, 15 aa, Mus sp.
ALLLNAPVVSITQGR

SEQ ID NO: 847 - protein, 19 aa, Mus sp.
EDYVELPPSVSQAAKSPPG

SEQ ID NO: 848 - protein, 13 aa, Mus sp.
VLLPFFDPDTNIV

SEQ ID NO: 849 - protein, 17 aa, Mus sp.
VPDVQFKTPQISMSDID

SEQ ID NO: 850 - protein, 22 aa, Mus sp.
LPNKPTVTVVSPLPNDSINPQP

SEQ ID NO: 851 - protein, 14 aa, Mus sp.
NELDYYDSPSVNAR

SEQ ID NO: 852 - protein, 14 aa, Mus sp.
AFRVPTPNVSVVDL

SEQ ID NO: 853 - protein, 15 aa, Mus sp.
AMLQVLGPKPALPEG

SEQ ID NO: 854 - protein, 16 aa, Mus sp.
VKARVANPSGNLTDTY

SEQ ID NO: 855 - protein, 17 aa, Mus sp.
EEAGAYDGPRTADGIVS

SEQ ID NO: 856 - protein, 16 aa, Mus sp.
DVDFDFAGPAIHGSAV

SEQ ID NO: 857 - protein, 15 aa, Mus sp.
LEEQLGPVAEETRAR

SEQ ID NO: 858 - protein, 16 aa, Mus sp.
GLEEPVLKHWEPEIPA

SEQ ID NO: 859 - protein, 16 aa, Mus sp.
APDMVYLGSMTNFDVT

SEQ ID NO: 860 - protein, 15 aa, Mus sp.
LRDNYRFAHTNIESL

SEQ ID NO: 861 - protein, 19 aa, Mus sp.
YKKELEEQLGPVAEETRAR

SEQ ID NO: 862 - protein, 12 aa, Mus sp.
VPIVEPEILPDG

SEQ ID NO: 863 - protein, 20 aa, Mus sp.
TPPSPKVTYKAPVPTGEVYF

SEQ ID NO: 864 - protein, 19 aa, Mus sp.
GPGGKWMIPPEAKESMDKN

SEQ ID NO: 865 - protein, 14 aa, Mus sp.
INDYKGAVIVVSHD

SEQ ID NO: 866 - protein, 17 aa, Mus sp.
GEQSWIQALPSVAKEEK

SEQ ID NO: 867 - protein, 14 aa, Mus sp.
SNSYGIPEPAHAYA

SEQ ID NO: 868 - protein, 13 aa, Mus sp.
VQIYHNPTANSFR

SEQ ID NO: 869 - protein, 14 aa, Mus sp.
YLPYKSPGINVDSS

SEQ ID NO: 870 - protein, 17 aa, Mus sp.
DPEDHTVSFVQPNGAIF

SEQ ID NO: 871 - protein, 17 aa, Mus sp.
EEKYTVIYPYTARDQDE

SEQ ID NO: 872 - protein, 18 aa, Mus sp.
FGNSEFDPPGPNVATTTV

SEQ ID NO: 873 - protein, 24 aa, Mus sp.
SPDDADFVDVLHTFTRGSPGRSIG

SEQ ID NO: 874 - protein, 16 aa, Mus sp.
EPRVLPYHPAQPGQAT

SEQ ID NO: 875 - protein, 17 aa, Mus sp.
FPLKEDNWSLPNRAVEP

SEQ ID NO: 876 - protein, 14 aa, Mus sp.
TKWFSAPLLLEASE

SEQ ID NO: 877 - protein, 17 aa, Mus sp.
DKEKVIVDFSSPNIAKE

SEQ ID NO: 878 - protein, 16 aa, Mus sp.
IFGIHHNPSVWPDPEV

SEQ ID NO: 879 - protein, 17 aa, Mus sp.
KELEEQLGPVAEETRAR

SEQ ID NO: 880 - protein, 12 aa, Mus sp.
KQIVWNGPVGVF

SEQ ID NO: 881 - protein, 13 aa, Mus sp.
KFPDWSFPSAWVS

SEQ ID NO: 882 - protein, 15 aa, Mus sp.
GDISISGPKVNVEAP

SEQ ID NO: 883 - protein, 16 aa, Mus sp.
GEQKLFISPGLLPEAP

SEQ ID NO: 884 - protein, 16 aa, Mus sp.
LDDPIWRGPLPSNGVM

SEQ ID NO: 885 - protein, 15 aa, Mus sp.
ARQNFTEPTAIQAQG

SEQ ID NO: 886 - protein, 18 aa, Mus sp.
HPPQEATNSPKPQPSYEE

SEQ ID NO: 887 - protein, 15 aa, Mus sp.
TGVDFIGSTVGLAKV

SEQ ID NO: 888 - protein, 16 aa, Mus sp.
AVDVFFPPEAQNDFPV

SEQ ID NO: 889 - protein, 15 aa, Mus sp.
SKATYSTNSPVWEEA

SEQ ID NO: 890 - protein, 23 aa, Mus sp.
IQEMEKEDRRYNPPIIHQGFQDT

SEQ ID NO: 891 - protein, 26 aa, Mus sp.
LPNKPTVTVVSPLPNDSINPQPSPDG

SEQ ID NO: 892 - protein, 16 aa, Mus sp.
DFSTFLSPNVLEEVDS

SEQ ID NO: 893 - protein, 16 aa, Mus sp.
SPVTTASMSGCLSFYY

SEQ ID NO: 894 - protein, 16 aa, Mus sp.
TPERLNSPVTIPAVMF

SEQ ID NO: 895 - protein, 13 aa, Mus sp.
ITWTWQGPGALKI

SEQ ID NO: 896 - protein, 18 aa, Mus sp.
APAAAATTAAPAAAAAPA

SEQ ID NO: 897 - protein, 16 aa, Mus sp.
DLVDAVTPSPQPSKEE

SEQ ID NO: 898 - protein, 15 aa, Mus sp.
EQLEWLSQRANALLA

SEQ ID NO: 899 - protein, 16 aa, Mus sp.
ASVATNPIITPVAQEN

SEQ ID NO: 900 - protein, 14 aa, Mus sp.
RERYNFPNPNPFVE

SEQ ID NO: 901 - protein, 17 aa, Mus sp.
DDDVNTYNAAIAYTIVS

SEQ ID NO: 902 - protein, 20 aa, Mus sp.
FEDYVELPPSVSQAATSPPG

SEQ ID NO: 903 - protein, 20 aa, Mus sp.
KGEQIYYAGPVNNPGLDVPQ

SEQ ID NO: 904 - protein, 18 aa, Mus sp.
DLERFLSSAAAVSKEHPV

SEQ ID NO: 905 - protein, 15 aa, Mus sp.
KERASFITPVPGGVG

SEQ ID NO: 906 - protein, 17 aa, Mus sp.
VPDDLLYSFPVVIKNKT

SEQ ID NO: 907 - protein, 17 aa, Mus sp.
INKMDDPTVNWSNERYE

SEQ ID NO: 908 - protein, 19 aa, Mus sp.
VDFVAWATGEPNFANDDEN

SEQ ID NO: 909 - protein, 18 aa, Mus sp.
APVEGASPTSISAVDGLT

SEQ ID NO: 910 - protein, 17 aa, Mus sp.
VDAGNAFKKADPQEAIN

SEQ ID NO: 911 - protein, 12 aa, Mus sp.
LVYTSPVIPELK

SEQ ID NO: 912 - protein, 17 aa, Mus sp.
TGYPTAYPAAAPAYNPS

SEQ ID NO: 913 - protein, 14 aa, Mus sp.
RLDNYDAPDIANIA

SEQ ID NO: 914 - protein, 17 aa, Mus sp.
NHIEVWERPLSNLAWAV

SEQ ID NO: 915 - protein, 14 aa, Mus sp.
NLDWQYPGSRGSPP

SEQ ID NO: 916 - protein, 8 aa, Mus sp.
AAYEFTTL

SEQ ID NO: 917 - protein, 19 aa, Mus sp.
GFPKPPSYNVATTLPSYDE

SEQ ID NO: 918 - protein, 14 aa, Mus sp.
NVDPFKAVDTNRAS

SEQ ID NO: 919 - protein, 15 aa, Mus sp.
LAVLEQEPIVLPAWD

SEQ ID NO: 920 - protein, 17 aa, Mus sp.
VIKSGYKIPELSQSLDY

SEQ ID NO: 921 - protein, 16 aa, Mus sp.
KKVIYSQPSTRSEGEF

SEQ ID NO: 922 - protein, 16 aa, Mus sp.
HTVSFVQPNGAIFEPS

SEQ ID NO: 923 - protein, 24 aa, Mus sp.
IQEMEKEDRRYNPPIIHQGFQDTS

SEQ ID NO: 924 - protein, 19 aa, Mus sp.
ADWQGGVYASPSIAGSRPG

SEQ ID NO: 925 - protein, 19 aa, Mus sp.
DVKKPAAAPAPAPAPAPAP

SEQ ID NO: 926 - protein, 16 aa, Mus sp.
FKKPSWLTPVPESHKL

SEQ ID NO: 927 - protein, 15 aa, Mus sp.
YQMYGGPVVLVAHSM

SEQ ID NO: 928 - protein, 18 aa, Mus sp.
FPTLKFFPASADRTVIDY

SEQ ID NO: 929 - protein, 18 aa, Mus sp.
DPTAGHSNAPIAAPAEVE

SEQ ID NO: 930 - protein, 14 aa, Mus sp.
TSIEYVTQRNCNLT

SEQ ID NO: 931 - protein, 17 aa, Mus sp.
KGADKTVKGPDGLTALE

SEQ ID NO: 932 - protein, 15 aa, Mus sp.
ESEEEYSAPLPTPAP

SEQ ID NO: 933 - protein, 17 aa, Mus sp.
NNQDFRGSAGAPSVENV

SEQ ID NO: 934 - protein, 14 aa, Mus sp.
TPEYLAPEIILSKG

SEQ ID NO: 935 - protein, 15 aa, Mus sp.
YTIPFYTPIPNGLYP

SEQ ID NO: 936 - protein, 11 aa, Mus sp.
KYSVWIGGSIL

SEQ ID NO: 937 - protein, 20 aa, Mus sp.
APISSHTAPRPNPTPALPQP

SEQ ID NO: 938 - protein, 14 aa, Mus sp.
GTPEFLAPEVLTDT

SEQ ID NO: 939 - protein, 18 aa, Mus sp.
APAPAAAPAAAPAAAPEP

SEQ ID NO: 940 - protein, 18 aa, Mus sp.
GDLSQHATPLPTPAVLPG

SEQ ID NO: 941 - protein, 14 aa, Mus sp.
FDYSGSQAIKALKE

SEQ ID NO: 942 - protein, 14 aa, Mus sp.
EFDYSGSQAIKALK

SEQ ID NO: 943 - protein, 18 aa, Mus sp.
ASLEDFYGSPIPSVSLKL

SEQ ID NO: 944 - protein, 18 aa, Mus sp.
LPQDPTFHTPLDLYAYAR

SEQ ID NO: 945 - protein, 16 aa, Mus sp.
SHPQYAEPGAEAAFSG

SEQ ID NO: 946 - protein, 18 aa, Mus sp.
CASLLRARLLLQLAQSQQ

SEQ ID NO: 947 - protein, 18 aa, Mus sp.
TDKFWGPSGAESVIGGVH

SEQ ID NO: 948 - protein, 20 aa, Mus sp.
LIGRTWNDPSVQQDIKFLPF

SEQ ID NO: 949 - protein, 17 aa, Mus sp.
APLDELVGAYPNYNEEE

SEQ ID NO: 950 - protein, 16 aa, Mus sp.
GPPPYHESLAGASQPP

SEQ ID NO: 951 - protein, 15 aa, Mus sp.
HDLDFRAPHVLVLGS

SEQ ID NO: 952 - protein, 15 aa, Mus sp.
KFIYVDVLPEEAVGP

SEQ ID NO: 953 - protein, 20 aa, Mus sp.
ITVKELFTTPVLRASVSSPF

SEQ ID NO: 954 - protein, 20 aa, Mus sp.
NNLGLFINHYPNGVVTVNCA

SEQ ID NO: 955 - protein, 11 aa, Mus sp.
LEVVKKDYDAL

SEQ ID NO: 956 - protein, 16 aa, Mus sp.
SLEDFYGSPIPSVSLK

SEQ ID NO: 957 - protein, 16 aa, Mus sp.
QRYSYQYTVANKEYVA

SEQ ID NO: 958 - protein, 16 aa, Mus sp.
FVEEFIWPAVQSSALY

SEQ ID NO: 959 - protein, 16 aa, Mus sp.
IPEAQWQSSLARTSSA

SEQ ID NO: 960 - protein, 16 aa, Mus sp.
DSGGFYISPRSTFSSL

SEQ ID NO: 961 - protein, 16 aa, Mus sp.
LSLKYHFVTPLTSMVV

SEQ ID NO: 962 - protein, 21 aa, Mus sp.
ITVKELFTTPVLRASVSSPFP

SEQ ID NO: 963 - protein, 15 aa, Mus sp.
GTPFWMAPEVIQEIG

SEQ ID NO: 964 - protein, 14 aa, Mus sp.
GTPDYIAPEIIAYQ

SEQ ID NO: 965 - protein, 17 aa, Mus sp.
GNHTLFHNPHVNPLPTG

SEQ ID NO: 966 - protein, 16 aa, Mus sp.
MYQMYGGPVVLVAHSM

SEQ ID NO: 967 - protein, 19 aa, Mus sp.
APAAAATTAAPAAAAAPAK

SEQ ID NO: 968 - protein, 17 aa, Mus sp.
MPDMHFKTPKISMPDVD

SEQ ID NO: 969 - protein, 17 aa, Mus sp.
SMPDYKPSFPKWARQDF

SEQ ID NO: 970 - protein, 15 aa, Mus sp.
NHTLFHNPHVNPLPT

SEQ ID NO: 971 - protein, 16 aa, Mus sp.
HNTEFKDSTYDLPRSL

SEQ ID NO: 972 - protein, 17 aa, Mus sp.
LDKDSFSDPYAHVSFLH

SEQ ID NO: 973 - protein, 19 aa, Mus sp.
VGTPDYISPEVLKSQGGDG

SEQ ID NO: 974 - protein, 17 aa, Mus sp.
SLLLHWQPPLSHNGVLT

SEQ ID NO: 975 - protein, 14 aa, Mus sp.
EVQWQSAEPGSTPR

SEQ ID NO: 976 - protein, 13 aa, Mus sp.
YVTQFHPPHIEIQ

SEQ ID NO: 977 - protein, 18 aa, Mus sp.
HNDLQYAAPGGLIGVGTK

SEQ ID NO: 978 - protein, 15 aa, BOVIN
GAEAEAPSAVPDAAG

SEQ ID NO: 979 - protein, 15 aa, Mus sp.
GPPIFNPVANEVYLN

SEQ ID NO: 980 - protein, 15 aa, Mus sp.
SVFVAPAVTPVKGVL

SEQ ID NO: 981 - protein, 21 aa, Mus sp.
SPLPVPVYAPKIPNQFRPDPP

SEQ ID NO: 982 - protein, 20 aa, Mus sp.
GPEAPLDELVGAYPNYNEEE

SEQ ID NO: 983 - protein, 17 aa, Mus sp.
ASLEDFYGSPIPSVSLK

SEQ ID NO: 984 - protein, 11 aa, Mus sp.
SVFVAPRKGIY

SEQ ID NO: 985 - protein, 15 aa, Mus sp.
FEVQWQSAEPGSTPR

SEQ ID NO: 986 - protein, 19 aa, Mus sp.
GGPGSAVSPYPSFNVSSDV

SEQ ID NO: 987 - protein, 19 aa, Mus sp.
GSGNSTGFGEHGSSSHPLP

SEQ ID NO: 988 - protein, 15 aa, Mus sp.
TSDIFGSPVTATAPL

SEQ ID NO: 989 - protein, 16 aa, Mus sp.
DSENMEREAETVDLDD

SEQ ID NO: 990 - protein, 16 aa, Mus sp.
TGMAFRVPTPNVSVVD

SEQ ID NO: 991 - protein, 13 aa, Mus sp.
PPSYYTQPVPVPN

SEQ ID NO: 992 - protein, 25 aa, Mus sp.
FPGPNIGGDTHFDSAEPWTVQNEDL

SEQ ID NO: 993 - protein, 16 aa, Mus sp.
LDLLDLAPEPRYAHIP

SEQ ID NO: 994 - protein, 13 aa, Mus sp.
SDEGERYIAPTVL

SEQ ID NO: 995 - protein, 15 aa, Mus sp.
APISSHTAPRPNPTP

SEQ ID NO: 996 - protein, 15 aa, Mus sp.
SMRYFETAVSRPGLE

SEQ ID NO: 997 - protein, 15 aa, Mus sp.
FPIKWTAPEAALYGR

SEQ ID NO: 998 - protein, 16 aa, Mus sp.
IPKTKFGKPDPIVSVI

SEQ ID NO: 999 - protein, 16 aa, Mus sp.
IQPFHRAAAIQAISLD

SEQ ID NO: 1000 - protein, 17 aa, Mus sp.
VDEYDYSKPIQGQQKKP

SEQ ID NO: 1001 - protein, 17 aa, Mus sp.
VTEDNVFEAPTLVKVFK

SEQ ID NO: 1002 - protein, 14 aa, Mus sp.
DYLKWLFPTSMRSN

SEQ ID NO: 1003 - protein, 14 aa, Mus sp.
IPTYTKPNPNQIIS

SEQ ID NO: 1004 - protein, 17 aa, Mus sp.
EEWGPFKAPHANRFIFS

SEQ ID NO: 1005 - protein, 16 aa, Mus sp.
SPHPYQLPQALAPHVD

SEQ ID NO: 1006 - protein, 16 aa, Mus sp.
APFDWEGAQASQALLL

SEQ ID NO: 1007 - protein, 16 aa, Mus sp.
DPTNPFRFPNIGVEKF

SEQ ID NO: 1008 - protein, 23 aa, Mus sp.
DPTSVTLKPMEIRTFLASVQWQE

SEQ ID NO: 1009 - protein, 19 aa, Mus sp.
GVEAARDNMFSGSKINYTE

SEQ ID NO: 1010 - protein, 15 aa, Mus sp.
EGEMTLKSALALAVK

SEQ ID NO: 1011 - protein, 14 aa, Mus sp.
KQEYDESGPSIVHR

SEQ ID NO: 1012 - protein, 17 aa, Mus sp.
EYQQYQDATAEEEEDFG

SEQ ID NO: 1013 - protein, 14 aa, Mus sp.
VDEYDYSKPIQGQQ

SEQ ID NO: 1014 - protein, 20 aa, Mus sp.
LEALGHMFMYFLRGSLPWQG

SEQ ID NO: 1015 - protein, 18 aa, Mus sp.
GEVKAFFESHPAPSAERT

SEQ ID NO: 1016 - protein, 14 aa, Mus sp.
AGGHKVGLGFELEA

SEQ ID NO: 1017 - protein, 18 aa, Mus sp.
GPDFEYVSPIPAWARDDW

SEQ ID NO: 1018 - protein, 18 aa, Mus sp.
ITDKFWGPSGAESVIGGV

SEQ ID NO: 1019 - protein, 19 aa, Mus sp.
FEDYVELPPSVSQAAKSPP

SEQ ID NO: 1020 - protein, 12 aa, Mus sp.
AGWFDQIAVKVA

SEQ ID NO: 1021 - protein, 13 aa, Mus sp.
VHLRVFQPLPHEN

SEQ ID NO: 1022 - protein, 14 aa, Mus sp.
DLDETRQAIVNAAK

SEQ ID NO: 1023 - protein, 17 aa, Mus sp.
KAVDVFFPPEAQNDFPV

SEQ ID NO: 1024 - protein, 12 aa, Mus sp.
FSYAFPKAVSVF

SEQ ID NO: 1025 - protein, 17 aa, Mus sp.
GDVVHGFYNPAVSRIVE

SEQ ID NO: 1026 - protein, 18 aa, Mus sp.
TPVFVHAGPFANIAHGNS

SEQ ID NO: 1027 - protein, 17 aa, Mus sp.
EAQVEFMASHGNEAARA

SEQ ID NO: 1028 - protein, 16 aa, Mus sp.
TDKFWGPSGAESVIGG

SEQ ID NO: 1029 - protein, 19 aa, Mus sp.
IGDTIEFRGPNGLLVYQGK

SEQ ID NO: 1030 - protein, 13 aa, Mus sp.
FDIFYTAPQPGKY

SEQ ID NO: 1031 - protein, 8 aa, Mus sp.
SVYSFLFL

SEQ ID NO: 1032 - protein, 14 aa, Mus sp.
FDFAGPAIHGSAVF

SEQ ID NO: 1033 - protein, 16 aa, Mus sp.
KLLEAKGPVTDVAYSH

SEQ ID NO: 1034 - protein, 17 aa, Mus sp.
LNVLRIINEPTAAAIAY

SEQ ID NO: 1035 - protein, 13 aa, Mus sp.
DFVAWATGEPNFA

SEQ ID NO: 1036 - protein, 20 aa, Mus sp.
QPSTSSLAAPTVEAAASAPA

SEQ ID NO: 1037 - protein, 14 aa, Mus sp.
NVTELNEPLSNEER

SEQ ID NO: 1038 - protein, 14 aa, Mus sp.
EVEHWFYPQENIID

SEQ ID NO: 1039 - protein, 16 aa, Mus sp.
SLHLRFSAPQIENEPE

SEQ ID NO: 1040 - protein, 13 aa, Mus sp.
LEPYLEPRSPEAR

SEQ ID NO: 1041 - protein, 15 aa, Mus sp.
MAFRVPTPNVSVVDL

SEQ ID NO: 1042 - protein, 16 aa, Mus sp.
EEIEVAPPKAHEVRIK

SEQ ID NO: 1043 - protein, 15 aa, Mus sp.
KVPYVAQEIQEEIDE

SEQ ID NO: 1044 - protein, 18 aa, Mus sp.
TPAPTPAATPAASPAPVS

SEQ ID NO: 1045 - protein, 17 aa, Mus sp.
ITDKFWGPSGAESVIGG

SEQ ID NO: 1046 - protein, 17 aa, Mus sp.
IIEQSWGSPKVTKDGVT

SEQ ID NO: 1047 - protein, 18 aa, Mus sp.
VHKSFVEVNEEGTEAAAA

SEQ ID NO: 1048 - protein, 15 aa, Mus sp.
FPIKWTAPEAINFGS

SEQ ID NO: 1049 - protein, 29 aa, Mus sp.
AVGKVIPELNGKLTGMAFRVPTPNVSVVD

SEQ ID NO: 1050 - protein, 17 aa, Mus sp.
DTKVVFLSPAVPEEPEA

SEQ ID NO: 1051 - protein, 12 aa, Mus sp.
DNIFLSPLSIST

SEQ ID NO: 1052 - protein, 15 aa, Mus sp.
EELYMPPLVIKVIDH

SEQ ID NO: 1053 - protein, 20 aa, Mus sp.
EPPQVPAEAPQPRASEDSPR

SEQ ID NO: 1054 - protein, 17 aa, Mus sp.
IPSPGLMVFPKPQTALE

SEQ ID NO: 1055 - protein, 10 aa, Mus sp.
LDYYDSPSVN

SEQ ID NO: 1056 - protein, 13 aa, Mus sp.
VAYEAPSLATGYG

SEQ ID NO: 1057 - protein, 18 aa, Mus sp.
NPTDAYLDAMMNEAPGPI

SEQ ID NO: 1058 - protein, 15 aa, Mus sp.
YVPWNFHEPQPGQYE

SEQ ID NO: 1059 - protein, 14 aa, Mus sp.
ASLGWIGSIVSTAL

SEQ ID NO: 1060 - protein, 18 aa, Mus sp.
KLLEAKGPVTDVAYSHDG

SEQ ID NO: 1061 - protein, 14 aa, Mus sp.
LDIFNLPNVEISKD

SEQ ID NO: 1062 - protein, 14 aa, Mus sp.
VPWSPPQSNWNPWT

SEQ ID NO: 1063 - protein, 15 aa, Mus sp.
FGNIYSTPLALQMLM

SEQ ID NO: 1064 - protein, 17 aa, Mus sp.
LERESKVVVPPLPGKAF

SEQ ID NO: 1065 - protein, 16 aa, Mus sp.
GTKRYMAPEVLDDSIN

SEQ ID NO: 1066 - protein, 16 aa, Mus sp.
LPKEWLTPAALQSSVS

SEQ ID NO: 1067 - protein, 17 aa, Mus sp.
PTLDHYKEPSAIFQLPY

SEQ ID NO: 1068 - protein, 16 aa, Mus sp.
YAVDIRSPAISWVNNL

SEQ ID NO: 1069 - protein, 16 aa, Mus sp.
AEVEFSAPYPMEVIFE

SEQ ID NO: 1070 - protein, 18 aa, Mus sp.
AANEKAVHADFFNDFEDL

SEQ ID NO: 1071 - protein, 16 aa, Mus sp.
FLKKWETPSQNTAQLD

SEQ ID NO: 1072 - protein, 17 aa, Mus sp.
DPDSRGEYSWAVAQGVK

SEQ ID NO: 1073 - protein, 14 aa, Mus sp.
HTLFHNPHVNPLPT

SEQ ID NO: 1074 - protein, 17 aa, Mus sp.
IGGDPFAAPQVVPAFAS

SEQ ID NO: 1075 - protein, 17 aa, Mus sp.
SSPDIFDSPSPEEDKEE

SEQ ID NO: 1076 - protein, 14 aa, Mus sp.
PSYYTQPVPVPNAN

SEQ ID NO: 1077 - protein, 16 aa, Mus sp.
VRLVSQEPKALVSEWK

SEQ ID NO: 1078 - protein, 16 aa, Mus sp.
VPLPGMKWVDNHKGVF

SEQ ID NO: 1079 - protein, 14 aa, Mus sp.
RTWAWEAVEALESH

SEQ ID NO: 1080 - protein, 15 aa, Mus sp.
SIASFKDPKISTSLP

SEQ ID NO: 1081 - protein, 17 aa, Mus sp.
GNMHYDTPDIRRFDPVP

SEQ ID NO: 1082 - protein, 14 aa, Mus sp.
ESKVVVPPLPGKAF

SEQ ID NO: 1083 - protein, 14 aa, Mus sp.
MDGEWEAPQIANPK

SEQ ID NO: 1084 - protein, 17 aa, Mus sp.
SPCANDVALIGFMMKPS

SEQ ID NO: 1085 - protein, 16 aa, Mus sp.
DKDSFSDPYAHVSFLH

SEQ ID NO: 1086 - protein, 13 aa, Mus sp.
TVEYLAPWANQID

SEQ ID NO: 1087 - protein, 16 aa, Mus sp.
LDKDSFSDPYAHVSFL

SEQ ID NO: 1088 - protein, 14 aa, Mus sp.
QDAYHFFSPEPLNS

SEQ ID NO: 1089 - protein, 16 aa, Mus sp.
GIFTFEEPVTHVSESI

SEQ ID NO: 1090 - protein, 16 aa, Mus sp.
SKTVYEGPFASRSLSD

SEQ ID NO: 1091 - protein, 17 aa, Mus sp.
LKRSYSSPDITQALQEE

SEQ ID NO: 1092 - protein, 18 aa, Mus sp.
SILDRYYTPTISRERAVE

SEQ ID NO: 1093 - protein, 14 aa, Mus sp.
VLLPFFDPDTNIVY

SEQ ID NO: 1094 - protein, 19 aa, Mus sp.
TPAAPTSALGPKASPAPSH

SEQ ID NO: 1095 - protein, 14 aa, Mus sp.
KSLTIQPDPIVVPG

SEQ ID NO: 1096 - protein, 14 aa, Mus sp.
APFDWEGAQASQAL

SEQ ID NO: 1097 - protein, 18 aa, Mus sp.
GPLDQVRAALPTPALTPE

SEQ ID NO: 1098 - protein, 17 aa, Mus sp.
DIRSDWTNPEINKAVLH

SEQ ID NO: 1099 - protein, 11 aa, Mus sp.
VPWSPPQSNWN

SEQ ID NO: 1100 - protein, 21 aa, Mus sp.
LPEEVGEYRQPSGGSVPVSPG

SEQ ID NO: 1101 - protein, 11 aa, Mus sp.
VLDFVTPTPLG

SEQ ID NO: 1102 - protein, 15 aa, Mus sp.
VTYEWAPPVQNQALA

SEQ ID NO: 1103 - protein, 13 aa, Mus sp.
EVQWQSAEPGSTP

SEQ ID NO: 1104 - protein, 12 aa, Mus sp.
DSERHFVYQFMG

SEQ ID NO: 1105 - protein, 14 aa, Mus sp.
SSKNVFLSPMSISS

SEQ ID NO: 1106 - protein, 13 aa, Mus sp.
TVHWVAPRAPITG

SEQ ID NO: 1107 - protein, 21 aa, Listeria monocytogenes
SSYPGSDETPPVVNPGETNPP

SEQ ID NO: 1108 - protein, 13 aa, Mus sp.
EDNWSLPNRAVEP

SEQ ID NO: 1109 - protein, 14 aa, Mus sp.
EVGEYRQPSGGSVP

SEQ ID NO: 1110 - protein, 16 aa, Mus sp.
GKWKYEKPDGSPVFIA

SEQ ID NO: 1111 - protein, 16 aa, Mus sp.
LSLLYKVPYVAQEIQE

SEQ ID NO: 1112 - protein, 9 aa, Mus sp.
AVYTFETLL

SEQ ID NO: 1113 - protein, 21 aa, Mus sp.
YPPPPQSDSASSPSPSFSEDN

SEQ ID NO: 1114 - protein, 16 aa, Mus sp.
DITHTYKYPEGSPEER

SEQ ID NO: 1115 - protein, 16 aa, Mus sp.
IQRVQAMKSPDHNGED

SEQ ID NO: 1116 - protein, 14 aa, Mus sp.
LDIDSAPITARNTG

SEQ ID NO: 1117 - protein, 17 aa, Mus sp.
SPSSPEYTPASPKYSPT

SEQ ID NO: 1118 - protein, 19 aa, Mus sp.
HDGDSVVFAGPAGNSVETR

SEQ ID NO: 1119 - protein, 17 aa, Mus sp.
TDINAFVGAVSLTAADS

SEQ ID NO: 1120 - protein, 16 aa, Mus sp.
RATTYIDPRTGKSALD

SEQ ID NO: 1121 - protein, 13 aa, Mus sp.
KNLDYVATSIHEA

SEQ ID NO: 1122 - protein, 13 aa, Mus sp.
VELPPSVSQAATS

SEQ ID NO: 1123 - protein, 16 aa, Mus sp.
VKVIYKAPSENWAMEG

SEQ ID NO: 1124 - protein, 18 aa, Mus sp.
VDVFYSSGIPATARPYRP

SEQ ID NO: 1125 - protein, 17 aa, Mus sp.
GGYGTLQHGEDTVPQGP

SEQ ID NO: 1126 - protein, 16 aa, Mus sp.
YPHIVVGALAASAPIW

SEQ ID NO: 1127 - protein, 14 aa, Mus sp.
SNEFDYPSVGQLAH

SEQ ID NO: 1128 - protein, 17 aa, Mus sp.
IDWTYRPPSSSRTESIF

SEQ ID NO: 1129 - protein, 15 aa, Mus sp.
RPHWLEPTIYSSEED

SEQ ID NO: 1130 - protein, 13 aa, Mus sp.
GVDFIGSTVGLAK

SEQ ID NO: 1131 - protein, 16 aa, Mus sp.
NLDYVATSIHEAVTKI

SEQ ID NO: 1132 - protein, 13 aa, Mus sp.
GNSEFDPPGPNVA

SEQ ID NO: 1133 - protein, 17 aa, Mus sp.
KPGSDTIKPDVNKSKEY

SEQ ID NO: 1134 - protein, 16 aa, Mus sp.
AGEFDYSGSQAIKALK

SEQ ID NO: 1135 - protein, 19 aa, Mus sp.
DSVTTDHISPAGNIARNSP

SEQ ID NO: 1136 - protein, 16 aa, Mus sp.
ESKEAFQEALAAAGDK

SEQ ID NO: 1137 - protein, 12 aa, Mus sp.
LYNQVKDLQEQN

SEQ ID NO: 1138 - protein, 17 aa, Listeria monocytogenes
TKEKVVATPVSNVSTSS

SEQ ID NO: 1139 - protein, 21 aa, Mus sp.
GIKADKADKAAASGPASASAP

SEQ ID NO: 1140 - protein, 18 aa, Mus sp.
DYPYPTDFLGPLPANPVK

SEQ ID NO: 1141 - protein, 18 aa, Mus sp.
APISSHTAPRPNPTPALP

SEQ ID NO: 1142 - protein, 15 aa, Mus sp.
LDSQYRASAPNSHVP

SEQ ID NO: 1143 - protein, 16 aa, Mus sp.
TSSYSNPTIGYENRVL

SEQ ID NO: 1144 - protein, 13 aa, Mus sp.
VFDVTAPNTFKTL

SEQ ID NO: 1145 - protein, 15 aa, Mus sp.
ERASFITPVPGGVGP

SEQ ID NO: 1146 - protein, 16 aa, Mus sp.
DHRGTWNGPWVSTEVL

SEQ ID NO: 1147 - protein, 16 aa, Listeria monocytogenes
VERWNEKYAQAYPNVS

SEQ ID NO: 1148 - protein, 16 aa, Mus sp.
LPSTWSDPSVNISLDN

SEQ ID NO: 1149 - protein, 16 aa, Mus sp.
ERDSKIVVPPLPGKAL

SEQ ID NO: 1150 - protein, 15 aa, Mus sp.
SNLLLQSPGVLTAAR

SEQ ID NO: 1151 - protein, 13 aa, Mus sp.
DARSYTAAVANRA

SEQ ID NO: 1152 - protein, 15 aa, Mus sp.
TGMAFRVPTPNVSVV

SEQ ID NO: 1153 - protein, 18 aa, Mus sp.
LDKDSFSDPYAHVSFLHR

SEQ ID NO: 1154 - protein, 16 aa, Mus sp.
FKHAVSDPSILDSLDL

SEQ ID NO: 1155 - protein, 20 aa, Mus sp.
EKEDRRYNPPIIHQGFQDTS

SEQ ID NO: 1156 - protein, 15 aa, Mus sp.
KDGYQMAQPVFAPKN

SEQ ID NO: 1157 - protein, 14 aa, Mus sp.
GGDPFAAPQVVPAF

SEQ ID NO: 1158 - protein, 14 aa, Mus sp.
QKQQWITPFTNGDK

SEQ ID NO: 1159 - protein, 15 aa, Mus sp.
FPLATYAPVISAEKA

SEQ ID NO: 1160 - protein, 13 aa, Mus sp.
FPYVTPAPHEPVK

SEQ ID NO: 1161 - protein, 15 aa, Mus sp.
TPRDYYFALAHTVRD

SEQ ID NO: 1162 - protein, 16 aa, Mus sp.
SVPATFAPSPTPAVVS

SEQ ID NO: 1163 - protein, 16 aa, Mus sp.
GKFIYITPEELAAVAN

SEQ ID NO: 1164 - protein, 13 aa, Mus sp.
EQIAVVAPEPLLT

SEQ ID NO: 1165 - protein, 15 aa, Mus sp.
AVNWYAPLVAPISKD

SEQ ID NO: 1166 - protein, 16 aa, Mus sp.
KKAGYITPVPGGVGPM

SEQ ID NO: 1167 - protein, 13 aa, Mus sp.
NERFRCPEAIFQP

SEQ ID NO: 1168 - protein, 17 aa, Mus sp.
ESLHLRFSAPQIENEPE

SEQ ID NO: 1169 - protein, 18 aa, Mus sp.
KHWGEWSPAHPLEAEDTR

SEQ ID NO: 1170 - protein, 15 aa, Mus sp.
APAAAEAPAAAEAPA

SEQ ID NO: 1171 - protein, 13 aa, Mus sp.
TGMAFRVPTPNVS

SEQ ID NO: 1172 - protein, 17 aa, Mus sp.
AAPASAPTPSTPAPTPA

SEQ ID NO: 1173 - protein, 16 aa, Mus sp.
QASVATNPIITPVAQE

SEQ ID NO: 1174 - protein, 15 aa, Mus sp.
GKPYVLPSVRKAEAQ

SEQ ID NO: 1175 - protein, 16 aa, Mus sp.
NQLEALVGPEANVGPY

SEQ ID NO: 1176 - protein, 18 aa, Mus sp.
FPLKEDNWSLPNRAVEPQ

SEQ ID NO: 1177 - protein, 14 aa, Mus sp.
KFRFEEPVVLPDLS

SEQ ID NO: 1178 - protein, 13 aa, Mus sp.
YKPFQNPVPNQSP

SEQ ID NO: 1179 - protein, 12 aa, Mus sp.
IFYGASIASLSA

SEQ ID NO: 1180 - protein, 15 aa, Mus sp.
YDLKWEFPRENLEFG

SEQ ID NO: 1181 - protein, 13 aa, Mus sp.
STTEFEEPRVIDL

SEQ ID NO: 1182 - protein, 18 aa, Mus sp.
NNAYYLDKMHYSIEGKDT

SEQ ID NO: 1183 - protein, 15 aa, Mus sp.
DQKFYNFVVIHARAD

SEQ ID NO: 1184 - protein, 18 aa, Mus sp.
DTPTDVTHHPIPSEEDIN

SEQ ID NO: 1185 - protein, 16 aa, Mus sp.
WKQKYEETHAELEASQ

SEQ ID NO: 1186 - protein, 14 aa, Mus sp.
VPVYLAGAAGLSVG

SEQ ID NO: 1187 - protein, 15 aa, Mus sp.
DPTNPFRFPNIGVEK

SEQ ID NO: 1188 - protein, 20 aa, Mus sp.
DLYTAKGLFRAAVPSGASTG

SEQ ID NO: 1189 - protein, 17 aa, Mus sp.
YSAFSYVDPVITSISPR

SEQ ID NO: 1190 - protein, 18 aa, Mus sp.
VHKAFVEVNEEGTEAAAA

SEQ ID NO: 1191 - protein, 14 aa, Mus sp.
DRKIVYEGPELNHA

SEQ ID NO: 1192 - protein, 17 aa, Mus sp.
DPKLTYHGFTLEDAASP

SEQ ID NO: 1193 - protein, 13 aa, Mus sp.
FKVLAPQISFGLD

SEQ ID NO: 1194 - protein, 16 aa, Mus sp.
APPLPIKTPIPTPSTL

SEQ ID NO: 1195 - protein, 14 aa, Mus sp.
YAVDIRSPAISWVN

SEQ ID NO: 1196 - protein, 17 aa, Mus sp.
DSVTTDHISPAGNIARN

SEQ ID NO: 1197 - protein, 20 aa, Mus sp.
VPTVPLLPPQVNQSLASMPP

SEQ ID NO: 1198 - protein, 14 aa, Mus sp.
KPFQNPVPNQSPSS

SEQ ID NO: 1199 - protein, 15 aa, Mus sp.
NFPLKPGIPLPSPED

SEQ ID NO: 1200 - protein, 13 aa, Mus sp.
SALEYGMPVTLIG

SEQ ID NO: 1201 - protein, 17 aa, Mus sp.
KTPESFLGPNAALVDLD

SEQ ID NO: 1202 - protein, 20 aa, Mus sp.
KLYFHGVFRQRIEMLLSAQT

SEQ ID NO: 1203 - protein, 13 aa, Mus sp.
KLPFAAAQIGNSF

SEQ ID NO: 1204 - protein, 15 aa, Mus sp.
VDPYEEADAQIAQER

SEQ ID NO: 1205 - protein, 15 aa, Mus sp.
KGSVFSAPSASGTPN

SEQ ID NO: 1206 - protein, 17 aa, Mus sp.
TKKFRFEEPVVLPDLSD

SEQ ID NO: 1207 - protein, 23 aa, Listeria monocytogenes
RYVFDTAKATAASSYPGSDETPP

SEQ ID NO: 1208 - protein, 17 aa, Mus sp.
ISLPHFLHASPDVSEPI

SEQ ID NO: 1209 - protein, 14 aa, Mus sp.
FPIKWTAPEAALFG

SEQ ID NO: 1210 - protein, 14 aa, Mus sp.
DPYDQPNAIYIERH

SEQ ID NO: 1211 - protein, 21 aa, Mus sp.
QDPEDHTVSFVQPNGAIFEPS

SEQ ID NO: 1212 - protein, 19 aa, Mus sp.
ATITVYSFPESVELRPLPA

SEQ ID NO: 1213 - protein, 17 aa, Mus sp.
EIQPFHRAAAIQAISLD

SEQ ID NO: 1214 - protein, 17 aa, Mus sp.
VPPTPQPVAPTPSAAPA

SEQ ID NO: 1215 - protein, 17 aa, Mus sp.
GQGVFREATTEFSVDAR

SEQ ID NO: 1216 - protein, 17 aa, Mus sp.
DRSAWYMGPVTRQEAQT

SEQ ID NO: 1217 - protein, 11 aa, Mus sp.
LKPEYVAPLVL

SEQ ID NO: 1218 - protein, 17 aa, Mus sp.
GNPLNSVFVAPAVTPVK

SEQ ID NO: 1219 - protein, 16 aa, Mus sp.
GFQAYDFPAITTAQYS

SEQ ID NO: 1220 - protein, 17 aa, Mus sp.
NDLQYAAPGGLIGVGTK

SEQ ID NO: 1221 - protein, 16 aa, Mus sp.
APTPAATPAASPAPVS

SEQ ID NO: 1222 - protein, 19 aa, Mus sp.
KPVPAAPVPSPVAPAPVPS

SEQ ID NO: 1223 - protein, 24 aa, Mus sp.
DESGFPKPPSYNVATTLPSYDEAE

SEQ ID NO: 1224 - protein, 17 aa, Mus sp.
GPGGLWVWGAPAVAQLL

SEQ ID NO: 1225 - protein, 17 aa, Mus sp.
DLVDAVTPSPQPSKEED

SEQ ID NO: 1226 - protein, 16 aa, Mus sp.
TIFQHHFPAAIDSFQD

SEQ ID NO: 1227 - protein, 14 aa, Mus sp.
APDTRFVAPGALGN

SEQ ID NO: 1228 - protein, 15 aa, Mus sp.
KWKALYTDPKSSETA

SEQ ID NO: 1229 - protein, 15 aa, Mus sp.
SFKDPKISTSLPVLD

SEQ ID NO: 1230 - protein, 18 aa, Mus sp.
GRADFREPNAQVSRPIPD

SEQ ID NO: 1231 - protein, 13 aa, Mus sp.
EVLAPQVVLSLGG

SEQ ID NO: 1232 - protein, 15 aa, Mus sp.
VPPPFAAAAINEAID

SEQ ID NO: 1233 - protein, 12 aa, Mus sp.
EFDYSGSQAIKA

SEQ ID NO: 1234 - protein, 15 aa, Mus sp.
APHVAYMQPKANAPS

SEQ ID NO: 1235 - protein, 15 aa, Mus sp.
GDQPVFEIPLSNVSQ

SEQ ID NO: 1236 - protein, 11 aa, Mus sp.
TIWVSPSPILE

SEQ ID NO: 1237 - protein, 19 aa, Mus sp.
APSNYLNNPYVRKALHIPE

SEQ ID NO: 1238 - protein, 15 aa, Mus sp.
KSKYKASIAALEAKI

SEQ ID NO: 1239 - protein, 16 aa, Mus sp.
ATLEIKGPQADLIDAV

SEQ ID NO: 1240 - protein, 17 aa, Mus sp.
SPHPYQLPQALAPHVDF

SEQ ID NO: 1241 - protein, 14 aa, Mus sp.
LDQLFSGPLPGRLP

SEQ ID NO: 1242 - protein, 15 aa, Mus sp.
DTIEFRGPNGLLVYQ

SEQ ID NO: 1243 - protein, 20 aa, Listeria monocytogenes
VWTKPNKIEGAQKISALSTY

SEQ ID NO: 1244 - protein, 17 aa, Mus sp.
ETDSVVSSVTTKAKGVA

SEQ ID NO: 1245 - protein, 17 aa, Mus sp.
GTPEYLAPEIILSKGYN

SEQ ID NO: 1246 - protein, 15 aa, Mus sp.
YPNFAGPQAALANKS

SEQ ID NO: 1247 - protein, 17 aa, Mus sp.
APPLPIKTPIPTPSTLP

SEQ ID NO: 1248 - protein, 18 aa, Mus sp.
EWTKWVAGSTLPAWIPPS

SEQ ID NO: 1249 - protein, 16 aa, Mus sp.
GTPDYISPEVLKSQGG

SEQ ID NO: 1250 - protein, 17 aa, Mus sp.
GRPDAEYWNSQPEILER

SEQ ID NO: 1251 - protein, 16 aa, Mus sp.
APDTRFVAPGALGNAP

SEQ ID NO: 1252 - protein, 15 aa, Listeria monocytogenes
GINQAYTGSTALSDG

SEQ ID NO: 1253 - protein, 19 aa, Mus sp.
GLDIYVWRGAQATLSNTTK

SEQ ID NO: 1254 - protein, 19 aa, Mus sp.
FIHKSVVEVNEEGTEAAAA

SEQ ID NO: 1255 - protein, 17 aa, Mus sp.
FWPPVTNTEMFVTAPDN

SEQ ID NO: 1256 - protein, 18 aa, Mus sp.
GRRTDWEAPTGQPSAPGP

SEQ ID NO: 1257 - protein, 14 aa, Mus sp.
SPTYTPSSPSYSPS

SEQ ID NO: 1258 - protein, 17 aa, Mus sp.
MKIYYFAAVAHLHMGKQ

SEQ ID NO: 1259 - protein, 19 aa, Mus sp.
GLSGAEGARGPPGFKGHTG

SEQ ID NO: 1260 - protein, 16 aa, Mus sp.
VPNDKWFGSGALLSES

SEQ ID NO: 1261 - protein, 13 aa, Mus sp.
DGYQMAQPVFAPK

SEQ ID NO: 1262 - protein, 18 aa, Listeria monocytogenes
DDTTVKFTLPTVAPAFEN

SEQ ID NO: 1263 - protein, 19 aa, Mus sp.
EDDIEADHVGTYGISVYQS

SEQ ID NO: 1264 - protein, 15 aa, Mus sp.
KPVPAAPVPSPVAPA

SEQ ID NO: 1265 - protein, 15 aa, Mus sp.
SVGAWTGPMGNWAMF

SEQ ID NO: 1266 - protein, 16 aa, Mus sp.
TVPIYEGYALPHAILR

SEQ ID NO: 1267 - protein, 14 aa, Mus sp.
KGPAFVNPLIPENK

SEQ ID NO: 1268 - protein, 15 aa, Mus sp.
DLDIFNLPNVEISKD

SEQ ID NO: 1269 - protein, 16 aa, Mus sp.
LNLAYIGAVPHSGIEQ

SEQ ID NO: 1270 - protein, 18 aa, Mus sp.
SQMAQYFEPLTLAAVGAA

SEQ ID NO: 1271 - protein, 15 aa, Mus sp.
DIRWQQPSPSPTGPY

SEQ ID NO: 1272 - protein, 16 aa, Mus sp.
GQLPDYTSPVVLPYSR

SEQ ID NO: 1273 - protein, 16 aa, Mus sp.
GNMHYDTPDIRRFDPV

SEQ ID NO: 1274 - protein, 23 aa, Mus sp.
KPSEGEEEAASAGGPQVNPMPVT

SEQ ID NO: 1275 - protein, 11 aa, Mus sp.
ANVGWNGSTFA

SEQ ID NO: 1276 - protein, 13 aa, Mus sp.
TAYASYPSASVEN

SEQ ID NO: 1277 - protein, 24 aa, Mus sp.
IPELNGKLTGMAFRVPTPNVSVVD

SEQ ID NO: 1278 - protein, 15 aa, Mus sp.
AGMAVFTPVINGVGG

SEQ ID NO: 1279 - protein, 14 aa, Mus sp.
DAIQFATGMANALE

SEQ ID NO: 1280 - protein, 16 aa, Mus sp.
DTNLNDLGPRALEIYR

SEQ ID NO: 1281 - protein, 15 aa, Mus sp.
KSIYRYDLASGATEQ

SEQ ID NO: 1282 - protein, 14 aa, Mus sp.
QLEALVGPEANVGP

SEQ ID NO: 1283 - protein, 14 aa, Mus sp.
FEVQWQSAEPGSTP

SEQ ID NO: 1284 - protein, 16 aa, Mus sp.
VDHRGTWNGPWVSTEV

SEQ ID NO: 1285 - protein, 25 aa, Mus sp.
KDESGFPKPPSYNVATTLPSYDEAE

SEQ ID NO: 1286 - protein, 20 aa, Mus sp.
FAAEEFKVPAATSAIITNDG

SEQ ID NO: 1287 - protein, 14 aa, Mus sp.
SSPYNPPDLEEAAK

SEQ ID NO: 1288 - protein, 16 aa, Mus sp.
MKVEYHFLSPYVSPRE

SEQ ID NO: 1289 - protein, 17 aa, Mus sp.
LIGRTWNDPSVQQDIKF

SEQ ID NO: 1290 - protein, 20 aa, Mus sp.
WGIDPYDQPNAIYIERHEPF

SEQ ID NO: 1291 - protein, 16 aa, Mus sp.
NHIEVWERPLSNLAWA

SEQ ID NO: 1292 - protein, 21 aa, Mus sp.
EKIQASVATNPIITPVAQENQ

SEQ ID NO: 1293 - protein, 20 aa, Mus sp.
AGCEEAKLEIMEFVNFLKNP

SEQ ID NO: 1294 - protein, 17 aa, Mus sp.
ESEEEYSAPLPTPAPSS

SEQ ID NO: 1295 - protein, 18 aa, Mus sp.
NGNPLNSVFVAPAVTPVK

SEQ ID NO: 1296 - protein, 15 aa, Mus sp.
GSPYIAAKINEAKDL

SEQ ID NO: 1297 - protein, 13 aa, Mus sp.
HIEVWERPLSNLA

SEQ ID NO: 1298 - protein, 15 aa, Mus sp.
EKQGFHSGTPAASFN

SEQ ID NO: 1299 - protein, 17 aa, Mus sp.
SIASFKDPKISTSLPVL

SEQ ID NO: 1300 - protein, 15 aa, Mus sp.
EVDRYDAPGIAFYPG

SEQ ID NO: 1301 - protein, 16 aa, Mus sp.
STLIWAAPRLQSEVAE

SEQ ID NO: 1302 - protein, 16 aa, Mus sp.
KTPEIVAPESAHAAFD

SEQ ID NO: 1303 - protein, 14 aa, Mus sp.
DIRSDWTNPEINKA

SEQ ID NO: 1304 - protein, 18 aa, Mus sp.
RLYKKAYNDHKAKISIPV

SEQ ID NO: 1305 - protein, 17 aa, Mus sp.
EIKVYWDAPSPAPDHIR

SEQ ID NO: 1306 - protein, 17 aa, Mus sp.
LSRWEQEQIRKGINIPQ

SEQ ID NO: 1307 - protein, 13 aa, Mus sp.
INYQPPTVVPGGD

SEQ ID NO: 1308 - protein, 12 aa, Mus sp.
INYQPPTVVPGG

SEQ ID NO: 1309 - protein, 16 aa, Mus sp.
EEWGPFKAPHANRFIF

SEQ ID NO: 1310 - protein, 22 aa, Listeria monocytogenes
VMASDYTRGLSIRAIELVFENL

SEQ ID NO: 1311 - protein, 14 aa, Mus sp.
VQIYHNPTANSFRV

SEQ ID NO: 1312 - protein, 16 aa, Mus sp.
EDYVELPPSVSQAATS

SEQ ID NO: 1313 - protein, 17 aa, Mus sp.
NLRDNYRFAHTNIESLV

SEQ ID NO: 1314 - protein, 14 aa, Mus sp.
VNWYAPLVAPISKD

SEQ ID NO: 1315 - protein, 18 aa, Mus sp.
RPVKESYSGPSTALTYPS

SEQ ID NO: 1316 - protein, 14 aa, Mus sp.
KKFRFEEPVVLPDL

SEQ ID NO: 1317 - protein, 15 aa, Mus sp.
KTPEIVAPESAHAAF

SEQ ID NO: 1318 - protein, 17 aa, Mus sp.
EAPAAAEAPAAAEAPAA

SEQ ID NO: 1319 - protein, 17 aa, Mus sp.
GVPTVPLLPPQVNQSLA

SEQ ID NO: 1320 - protein, 15 aa, Mus sp.
GNSEFDPPGPNVATT

SEQ ID NO: 1321 - protein, 20 aa, Mus sp.
GADKTVKGPDGLTALEATDN

SEQ ID NO: 1322 - protein, 14 aa, Mus sp.
VTTDHISPAGNIAR

SEQ ID NO: 1323 - protein, 18 aa, Mus sp.
ADRFMDDIACMIGYRPCP

SEQ ID NO: 1324 - protein, 16 aa, Mus sp.
FPPEFYEHAKALWEDE

SEQ ID NO: 1325 - protein, 15 aa, Mus sp.
SLKYHFVTPLTSMVV

SEQ ID NO: 1326 - protein, 11 aa, Mus sp.
AEYWNSQPEIL

SEQ ID NO: 1327 - protein, 12 aa, Mus sp.
ISWEPPAVSVRY

SEQ ID NO: 1328 - protein, 16 aa, Mus sp.
IEHLYKNPQAHIEGNM

SEQ ID NO: 1329 - protein, 13 aa, Mus sp.
TTDYNSPEAGNIF

SEQ ID NO: 1330 - protein, 15 aa, Mus sp.
VADKEFHAPLIIDEN

SEQ ID NO: 1331 - protein, 14 aa, Mus sp.
TGVDFIGSTVGLAK

SEQ ID NO: 1332 - protein, 13 aa, Mus sp.
DIYVWRGAQATLS

SEQ ID NO: 1333 - protein, 16 aa, Mus sp.
INKMDDPTVNWSNERY

SEQ ID NO: 1334 - protein, 16 aa, Mus sp.
NNQAYHSPATALAIVD

SEQ ID NO: 1335 - protein, 16 aa, Mus sp.
VADLVKNPTASLVLPE

SEQ ID NO: 1336 - protein, 21 aa, Mus sp.
EDPNYSPQRFPNAHRAFADDP

SEQ ID NO: 1337 - protein, 12 aa, Mus sp.
GAWTGPMGNWAM

SEQ ID NO: 1338 - protein, 17 aa, Mus sp.
AAPHIYQNSFVQVVLNS

SEQ ID NO: 1339 - protein, 14 aa, Mus sp.
SSVAFIKPGVNKAE

SEQ ID NO: 1340 - protein, 15 aa, Mus sp.
TALTFSSPATNQAIT

SEQ ID NO: 1341 - protein, 13 aa, Mus sp.
LDWQYPGSRGSPP

SEQ ID NO: 1342 - protein, 14 aa, Mus sp.
KQIDYTVPTVIAEE

SEQ ID NO: 1343 - protein, 13 aa, Mus sp.
ETFNTPAMYVAIQ

SEQ ID NO: 1344 - protein, 20 aa, Mus sp.
GSNLSINTNQNINIKSEPIS

SEQ ID NO: 1345 - protein, 19 aa, Mus sp.
DGREVSSVEAPSVSPARHQ

SEQ ID NO: 1346 - protein, 19 aa, Mus sp.
EEKPVPAAPVPSPVAPAPV

SEQ ID NO: 1347 - protein, 24 aa, Mus sp.
GPGEPSPVSETVVTPEAAPEKNPV

SEQ ID NO: 1348 - protein, 17 aa, Mus sp.
AEQEVLAPQVVLSLGGS

SEQ ID NO: 1349 - protein, 21 aa, Mus sp.
ITFPLKQQRHTAAPTDPTDGP

SEQ ID NO: 1350 - protein, 8 aa, Mus sp.
HIYEFPQL

SEQ ID NO: 1351 - protein, 14 aa, Mus sp.
VFDVTAPNTFKTLD

SEQ ID NO: 1352 - protein, 17 aa, Mus sp.
DSNFGAPSASVAAAPAP

SEQ ID NO: 1353 - protein, 16 aa, Mus sp.
HKAFLEVNEEGSEAAA

SEQ ID NO: 1354 - protein, 13 aa, Mus sp.
LPDYSAPNPIKVT

SEQ ID NO: 1355 - protein, 14 aa, Mus sp.
LELEEPPLVLAAAN

SEQ ID NO: 1356 - protein, 17 aa, Mus sp.
DERFGVRFPAMSDAYDR

SEQ ID NO: 1357 - protein, 16 aa, Mus sp.
VYIPTYTKPNPNQIIS

SEQ ID NO: 1358 - protein, 16 aa, Mus sp.
EEAGAYDGPRTADGIV

SEQ ID NO: 1359 - protein, 30 aa, Mus sp.
DSRGNPTVEVDLYTAKGLFRAAVPSGASTG

SEQ ID NO: 1360 - protein, 17 aa, Mus sp.
LVKDGYQMAQPVFAPKN

SEQ ID NO: 1361 - protein, 16 aa, Mus sp.
IGNERFRCPEAIFQPS

SEQ ID NO: 1362 - protein, 16 aa, Mus sp.
KLQEFELPYVSVTSLR

SEQ ID NO: 1363 - protein, 14 aa, Mus sp.
FGNIYSTPLALQML

SEQ ID NO: 1364 - protein, 14 aa, Mus sp.
LALPYDTPVPGYMN

SEQ ID NO: 1365 - protein, 23 aa, Mus sp.
PPGFEDYVELPPSVSQAATSPPG

SEQ ID NO: 1366 - protein, 15 aa, Mus sp.
FFWNVAPGAESAVAS

SEQ ID NO: 1367 - protein, 16 aa, Listeria monocytogenes
GGINQAYTGSTALSDG

SEQ ID NO: 1368 - protein, 17 aa, Mus sp.
SNLSYREPDPEDAVGGS

SEQ ID NO: 1369 - protein, 18 aa, Mus sp.
LPDSWASGYAVPVVTVVR

SEQ ID NO: 1370 - protein, 15 aa, Mus sp.
HWGEWSPAHPLEAED

SEQ ID NO: 1371 - protein, 15 aa, Mus sp.
WNHRYGEPIPSTTLT

SEQ ID NO: 1372 - protein, 13 aa, Mus sp.
GVELYRAPFPLYA

SEQ ID NO: 1373 - protein, 13 aa, Mus sp.
SDVIHAPLPSPVD

SEQ ID NO: 1374 - protein, 17 aa, Mus sp.
TPVFVHAGPFANIAHGN

SEQ ID NO: 1375 - protein, 20 aa, Mus sp.
DGHGGYKPFQNPVPNQSPSS

SEQ ID NO: 1376 - protein, 15 aa, BOVIN
VVVGPSVVAVPLPLH

SEQ ID NO: 1377 - protein, 15 aa, Mus sp.
KDSFSDPYAHVSFLH

SEQ ID NO: 1378 - protein, 15 aa, Mus sp.
AGNAFKKADPQEAIN

SEQ ID NO: 1379 - protein, 18 aa, Mus sp.
MPDMHFKAPKISMPDVDL

SEQ ID NO: 1380 - protein, 15 aa, Mus sp.
LPSTSYLPSTPSVVP

SEQ ID NO: 1381 - protein, 16 aa, Mus sp.
EEKYTVIYPYTARDQD

SEQ ID NO: 1382 - protein, 16 aa, Mus sp.
LQNLYMQWNKISVIGQ

SEQ ID NO: 1383 - protein, 20 aa, Mus sp.
HDGDSVVFAGPAGNSVETRG

SEQ ID NO: 1384 - protein, 13 aa, BOVIN
SVVVGPSVVAVPL

SEQ ID NO: 1385 - protein, 19 aa, Mus sp.
TPDPNTAYASYPSASVENY

SEQ ID NO: 1386 - protein, 14 aa, Mus sp.
IQEPYTFPAILKSV

SEQ ID NO: 1387 - protein, 19 aa, Mus sp.
YPRDISNYGFPRSVQAIDA

SEQ ID NO: 1388 - protein, 18 aa, Mus sp.
FHKAFLEVNEEGSEAAAS

SEQ ID NO: 1389 - protein, 19 aa, Mus sp.
SPRDDARVYHDPSTQEPVT

SEQ ID NO: 1390 - protein, 14 aa, Mus sp.
DNMFSGSKINYTEN

SEQ ID NO: 1391 - protein, 16 aa, Mus sp.
KGVKYEAPQTTDGLAG

SEQ ID NO: 1392 - protein, 17 aa, Mus sp.
DEGERYIAPTVLVDVQE

SEQ ID NO: 1393 - protein, 19 aa, Mus sp.
TPRVLSQAPSPLYSVEFSE

SEQ ID NO: 1394 - protein, 15 aa, Mus sp.
IFYGASIASLSASHS

SEQ ID NO: 1395 - protein, 17 aa, Mus sp.
APAPAPAAAPAPAPAAQ

SEQ ID NO: 1396 - protein, 26 aa, Mus sp.
KDAGTIAGLNVLRIINEPTAAAIAYG

SEQ ID NO: 1397 - protein, 26 aa, Mus sp.
YPPPPQSDSASSPSPSFSEDNLPPPP

SEQ ID NO: 1398 - protein, 34 aa, Mus sp.
VPPSGPDTTPAASSESTEQLPNVQVEGPTPNRPR

SEQ ID NO: 1399 - protein, 19 aa, Mus sp.
GIDPYDQPNAIYIERHEPF

SEQ ID NO: 1400 - protein, 16 aa, Mus sp.
RERYNFPNPNPFVEDD

SEQ ID NO: 1401 - protein, 16 aa, Mus sp.
MRPFYQGPVGDPATYR

SEQ ID NO: 1402 - protein, 12 aa, Mus sp.
VVPWSPPQSNWN

SEQ ID NO: 1403 - protein, 17 aa, Mus sp.
KLLEAKGPVTDVAYSHD

SEQ ID NO: 1404 - protein, 13 aa, Mus sp.
YPYIPAHITKPKE

SEQ ID NO: 1405 - protein, 17 aa, Mus sp.
GDGRNYLLAFQKGIRNK

SEQ ID NO: 1406 - protein, 17 aa, Mus sp.
IEEIEVAPPKAHEVRIK

SEQ ID NO: 1407 - protein, 17 aa, Mus sp.
WGIDPYDQPNAIYIERH

SEQ ID NO: 1408 - protein, 19 aa, Mus sp.
SDMNDAYLGYASAVILRNR

SEQ ID NO: 1409 - protein, 16 aa, Mus sp.
GPEVDVSLPKANIDVS

SEQ ID NO: 1410 - protein, 16 aa, Mus sp.
GEEDWTISPVPQSIVD

SEQ ID NO: 1411 - protein, 12 aa, Mus sp.
RQTTQYPEANAL

SEQ ID NO: 1412 - protein, 16 aa, Mus sp.
RNRYWGTPIPLWVSED

SEQ ID NO: 1413 - protein, 18 aa, Mus sp.
KPVPAAPVPSPVAPAPVP

SEQ ID NO: 1414 - protein, 13 aa, Mus sp.
ADKEFHAPLIIDE

SEQ ID NO: 1415 - protein, 17 aa, Mus sp.
AINDYKGAVIVVSHDAR

SEQ ID NO: 1416 - protein, 20 aa, Mus sp.
GKLTGMAFRVPTPNVSVVDL

SEQ ID NO: 1417 - protein, 19 aa, Mus sp.
DDPTAGHSNAPIAAPAEVE

SEQ ID NO: 1418 - protein, 17 aa, Mus sp.
LEEKGVYVQASTLGSLE

SEQ ID NO: 1419 - protein, 16 aa, Mus sp.
SPDQWSSSSPHSASDW

SEQ ID NO: 1420 - protein, 16 aa, Mus sp.
DEEEVEVFLPKFKLEE

SEQ ID NO: 1421 - protein, 19 aa, Mus sp.
EPPQVPAEAPQPRASEDSP

SEQ ID NO: 1422 - protein, 15 aa, Mus sp.
VGDLYTDPQIHTEKG

SEQ ID NO: 1423 - protein, 16 aa, Mus sp.
EPPSDLDFFSPRPVPA

SEQ ID NO: 1424 - protein, 24 aa, Mus sp.
VPDGPEAPLDELVGAYPNYNEEEE

SEQ ID NO: 1425 - protein, 19 aa, Mus sp.
KIPEVDMARVVAPFMSNIP

SEQ ID NO: 1426 - protein, 17 aa, Mus sp.
GDMPTKLRRLDVHANQE

SEQ ID NO: 1427 - protein, 15 aa, Mus sp.
GDTHFDSAEPWTVQN

SEQ ID NO: 1428 - protein, 14 aa, Mus sp.
QIYYAGPVNNPGLD

SEQ ID NO: 1429 - protein, 19 aa, Mus sp.
LPPHVYSTPQPSLPPVQPS

SEQ ID NO: 1430 - protein, 17 aa, Mus sp.
GVPVPGSPFPLEAVAPT

SEQ ID NO: 1431 - protein, 16 aa, Mus sp.
LAVLEQEPIVLPAWDP

SEQ ID NO: 1432 - protein, 18 aa, Mus sp.
VGTARYMAPEVLESRMNL

SEQ ID NO: 1433 - protein, 20 aa, Mus sp.
DLDEQEFVYKEPAITKLPEI

SEQ ID NO: 1434 - protein, 16 aa, Mus sp.
KYHFVTPLTSMVVTKP

SEQ ID NO: 1435 - protein, 17 aa, Mus sp.
ESKEAFQEALAAAGDKL

SEQ ID NO: 1436 - protein, 17 aa, Mus sp.
DMFHYTSTTTKVPPPDT

SEQ ID NO: 1437 - protein, 14 aa, Mus sp.
MRYFETAVSRPGLE

SEQ ID NO: 1438 - protein, 14 aa, Mus sp.
HDLDFRAPHVLVLG

SEQ ID NO: 1439 - protein, 15 aa, Mus sp.
GYTYTASAIKHVITE

SEQ ID NO: 1440 - protein, 19 aa, Mus sp.
DIDTAAKFIGAGAATVGVA

SEQ ID NO: 1441 - protein, 14 aa, Mus sp.
VNFQEYVAFLGALA

SEQ ID NO: 1442 - protein, 14 aa, Mus sp.
KIGEHTPSALAIME

SEQ ID NO: 1443 - protein, 25 aa, Mus sp.
ANLMEKIQASVATNPIITPVAQENQ

SEQ ID NO: 1444 - protein, 14 aa, Mus sp.
ALPYDTPVPGYMNN

SEQ ID NO: 1445 - protein, 9 aa, Mus sp.
NVEIDPEIQ

SEQ ID NO: 1446 - protein, 19 aa, Mus sp.
SPVRFSTETTFLVDKYEIL

SEQ ID NO: 1447 - protein, 18 aa, Mus sp.
NTHDLDFRAPHVLVLGSG

SEQ ID NO: 1448 - protein, 22 aa, Mus sp.
WDLVDAVTPSPQPSKEEDGPPA

SEQ ID NO: 1449 - protein, 13 aa, Mus sp.
KTQYISPNLNPND

SEQ ID NO: 1450 - protein, 19 aa, Listeria monocytogenes
SNVNHVLDIGYGGGSNVKN

SEQ ID NO: 1451 - protein, 17 aa, Mus sp.
APAAAATTAAPAAAAAP

SEQ ID NO: 1452 - protein, 16 aa, Mus sp.
AAATTAAPAAAAAPAK

SEQ ID NO: 1453 - protein, 14 aa, Mus sp.
KLISFSPTVNTSVS

SEQ ID NO: 1454 - protein, 15 aa, Mus sp.
EVEHWFYPQENIIDT

SEQ ID NO: 1455 - protein, 31 aa, Mus sp.
DLDENLPNKPTVTVVSPLPNDSINPQPSPDG

SEQ ID NO: 1456 - protein, 16 aa, Mus sp.
DPSAFAAAAPAAAATT

SEQ ID NO: 1457 - protein, 14 aa, Mus sp.
STDYGNFLANEASP

SEQ ID NO: 1458 - protein, 17 aa, Mus sp.
GGDTHFDSAEPWTVQNE

SEQ ID NO: 1459 - protein, 26 aa, Mus sp.
KVIPELNGKLTGMAFRVPTPNVSVVD

SEQ ID NO: 1460 - protein, 16 aa, Mus sp.
LEDFYGSPIPSVSLKL

SEQ ID NO: 1461 - protein, 16 aa, Mus sp.
DTVTISGPQAAVNEFV

SEQ ID NO: 1462 - protein, 17 aa, Mus sp.
EDITHTYKYPEGSPEER

SEQ ID NO: 1463 - protein, 19 aa, Mus sp.
EDYVELPPSVSQAATSPPG

SEQ ID NO: 1464 - protein, 17 aa, Mus sp.
WKALYTDPKSSETAAFV

SEQ ID NO: 1465 - protein, 13 aa, Mus sp.
AGNFYVPAEPKLA

SEQ ID NO: 1466 - protein, 18 aa, Mus sp.
KPGSDTIKPDVNKSKEYF

SEQ ID NO: 1467 - protein, 14 aa, Mus sp.
FIVKYELPLVIKAL

SEQ ID NO: 1468 - protein, 17 aa, Mus sp.
ITVKELFTTPVLRASVS

SEQ ID NO: 1469 - protein, 15 aa, Mus sp.
TEEKYHEALAKGDVT

SEQ ID NO: 1470 - protein, 15 aa, Mus sp.
ARDNMFSGSKINYTE

SEQ ID NO: 1471 - protein, 15 aa, Mus sp.
LPDYSAPNPIKVTHR

SEQ ID NO: 1472 - protein, 17 aa, Mus sp.
TRSQVTPSVPSEALDDS

SEQ ID NO: 1473 - protein, 16 aa, Mus sp.
DGNHTLFHNPHVNPLP

SEQ ID NO: 1474 - protein, 18 aa, Mus sp.
EQPGLNGAAAAAAAEAPD

SEQ ID NO: 1475 - protein, 18 aa, Mus sp.
AGHFRSPHTTEVVGGAPQ

SEQ ID NO: 1476 - protein, 16 aa, Mus sp.
APISSHTAPRPNPTPA

SEQ ID NO: 1477 - protein, 13 aa, Mus sp.
DVDFDFAGPAIHG

SEQ ID NO: 1478 - protein, 18 aa, Mus sp.
MEKEDRRYNPPIIHQGFQ

SEQ ID NO: 1479 - protein, 18 aa, Mus sp.
APDAWDYSQGFVNEEMIR

SEQ ID NO: 1480 - protein, 13 aa, Mus sp.
SIASFKDPKISTS

SEQ ID NO: 1481 - protein, 16 aa, Mus sp.
NLPENFRRPQTDQAVE

SEQ ID NO: 1482 - protein, 17 aa, Mus sp.
TVLEMYKVHNPVPLIVG

SEQ ID NO: 1483 - protein, 18 aa, Mus sp.
KPGTTVEYLAPWANQIDM

SEQ ID NO: 1484 - protein, 18 aa, Mus sp.
SMRYFETAVSRPGLEEPR

SEQ ID NO: 1485 - protein, 15 aa, Mus sp.
VSSYTPPQPSYSQPP

SEQ ID NO: 1486 - protein, 16 aa, Mus sp.
TETQEKNPLPSKETIE

SEQ ID NO: 1487 - protein, 19 aa, Mus sp.
EMEKEDRRYNPPIIHQGFQ

SEQ ID NO: 1488 - protein, 16 aa, Mus sp.
GSPAFQPPEIANGLDT

SEQ ID NO: 1489 - protein, 18 aa, Mus sp.
VGGERFEAPEALFQPHLI

SEQ ID NO: 1490 - protein, 14 aa, Mus sp.
DKEFHAPLIIDENG

SEQ ID NO: 1491 - protein, 19 aa, Mus sp.
LPPYDDATAVPSTAKEPPP

SEQ ID NO: 1492 - protein, 17 aa, Mus sp.
EVSSVEAPSVSPARHQL

SEQ ID NO: 1493 - protein, 16 aa, Mus sp.
GALLLNAPVVSITQGR

SEQ ID NO: 1494 - protein, 15 aa, Mus sp.
LAETVAPAVRGANPH

SEQ ID NO: 1495 - protein, 12 aa, Mus sp.
IEGYVPSQADVA

SEQ ID NO: 1496 - protein, 16 aa, Mus sp.
IEGYVPSQADVAVFEA

SEQ ID NO: 1497 - protein, 17 aa, Mus sp.
HGSLFLKTPKIVSSKDY

SEQ ID NO: 1498 - protein, 16 aa, Mus sp.
LRDMYSKSSAAMSTYA

SEQ ID NO: 1499 - protein, 17 aa, Mus sp.
IGNERFRCPEAIFQPSF

SEQ ID NO: 1500 - protein, 16 aa, Mus sp.
PLNSVFVAPAVTPVKG

SEQ ID NO: 1501 - protein, 14 aa, Mus sp.
KKNWFGPSPYVEVT

SEQ ID NO: 1502 - protein, 12 aa, Mus sp.
EEYSAPLPTPAP

SEQ ID NO: 1503 - protein, 9 aa, Mus sp.
LIMVMMEDY

SEQ ID NO: 1504 - protein, 17 aa, Mus sp.
MPEMHFKAPKVSLPDVD

SEQ ID NO: 1505 - protein, 21 aa, Mus sp.
APKETTIWVSPSPILEEGSPV

SEQ ID NO: 1506 - protein, 16 aa, Mus sp.
LALPYDTPVPGYMNNT

SEQ ID NO: 1507 - protein, 15 aa, Mus sp.
VGGERFEAPEALFQP

SEQ ID NO: 1508 - protein, 16 aa, Mus sp.
EQFVYSSPHDNKSWEM

SEQ ID NO: 1509 - protein, 15 aa, Mus sp.
EPSVFNGPEVTMLKD

SEQ ID NO: 1510 - protein, 13 aa, Mus sp.
IPFYTPIPNGLYP

SEQ ID NO: 1511 - protein, 16 aa, Mus sp.
EAPAAAEAPAAAEAPA

SEQ ID NO: 1512 - protein, 14 aa, Mus sp.
ALMYNTPRAATIIA

SEQ ID NO: 1513 - protein, 22 aa, Mus sp.
RAPETRSQVTPSVPSEALDDST

SEQ ID NO: 1514 - protein, 22 aa, Mus sp.
IEKDPAKGRIYQGTEADSIFSG

SEQ ID NO: 1515 - protein, 17 aa, Mus sp.
INMKQYASPMPTQTDVK

SEQ ID NO: 1516 - protein, 24 aa, Mus sp.
KPFPWGDGNHTLFHNPHVNPLPTG

SEQ ID NO: 1517 - protein, 14 aa, Mus sp.
SVPATFAPSPTPAV

SEQ ID NO: 1518 - protein, 16 aa, Mus sp.
VDRVLKSPVASIVYEL

SEQ ID NO: 1519 - protein, 19 aa, Mus sp.
VPDVDISSPGINVEAPDIH

SEQ ID NO: 1520 - protein, 13 aa, Mus sp.
LVFDVTAPNTFKT

SEQ ID NO: 1521 - protein, 19 aa, Mus sp.
VGAGHFRSPHTTEVVGGAP

SEQ ID NO: 1522 - protein, 17 aa, Mus sp.
IPEQSFYTKPLPGIIMG

SEQ ID NO: 1523 - protein, 12 aa, Mus sp.
NELDYYDSPSVN

SEQ ID NO: 1524 - protein, 15 aa, Mus sp.
VDPFKAVDTNRASMG

SEQ ID NO: 1525 - protein, 15 aa, Mus sp.
APYQGPDAAPGALDY

SEQ ID NO: 1526 - protein, 14 aa, Mus sp.
GPPPGWEGPHPQRG

SEQ ID NO: 1527 - protein, 15 aa, Mus sp.
LVFDVTAPNTFKTLD

SEQ ID NO: 1528 - protein, 15 aa, Mus sp.
DVYVFLGPEPKSVVQ

SEQ ID NO: 1529 - protein, 18 aa, Mus sp.
AAPHIYQNSFVQVVLNSL

SEQ ID NO: 1530 - protein, 13 aa, Mus sp.
EDFYGSPIPSVSL

SEQ ID NO: 1531 - protein, 15 aa, Mus sp.
LPPHVYSTPQPSLPP

SEQ ID NO: 1532 - protein, 17 aa, Mus sp.
EPPQYPYIPAHITKPKE

SEQ ID NO: 1533 - protein, 18 aa, Mus sp.
DDGTVIHFNNPKVQASLS

SEQ ID NO: 1534 - protein, 19 aa, Mus sp.
RPPGPPPAPQPPSPAPSPP

SEQ ID NO: 1535 - protein, 16 aa, Mus sp.
DDLQPWHPFGVDSVPA

SEQ ID NO: 1536 - protein, 17 aa, Mus sp.
TVPFWAHAGNAIPSADQ

SEQ ID NO: 1537 - protein, 15 aa, Mus sp.
GGSPYIAAKINEAKD

SEQ ID NO: 1538 - protein, 16 aa, Mus sp.
SNKQYLFPETLVIGEK

SEQ ID NO: 1539 - protein, 20 aa, Mus sp.
VTEDNVFEAPTLVKVFKQPS

SEQ ID NO: 1540 - protein, 16 aa, Mus sp.
AGPQWADPQISESNFS

SEQ ID NO: 1541 - protein, 17 aa, Mus sp.
DGDSYRSPWSNKYDPPL

SEQ ID NO: 1542 - protein, 18 aa, Mus sp.
FPKTNATSPGVNSSASPQ

SEQ ID NO: 1543 - protein, 14 aa, Mus sp.
IDQYQGADAVGLEE

SEQ ID NO: 1544 - protein, 17 aa, Mus sp.
GDSVVFAGPAGNSVETR

SEQ ID NO: 1545 - protein, 17 aa, Mus sp.
GDLSQHATPLPTPAVLP

SEQ ID NO: 1546 - protein, 13 aa, Mus sp.
FVAPAVTPVKGVL

SEQ ID NO: 1547 - protein, 13 aa, Mus sp.
ALVYTSPVIPELK

SEQ ID NO: 1548 - protein, 18 aa, Mus sp.
RSLQAFSNPSAGISVDVK

SEQ ID NO: 1549 - protein, 16 aa, Mus sp.
DGDSVVFAGPAGNSVE

SEQ ID NO: 1550 - protein, 16 aa, Mus sp.
SEEEYSAPLPTPAPSS

SEQ ID NO: 1551 - protein, 14 aa, Mus sp.
IPEFQLPHLSHTIE

SEQ ID NO: 1552 - protein, 15 aa, Mus sp.
DFLKKWETPSQNTAQ

SEQ ID NO: 1553 - protein, 15 aa, Mus sp.
GDPFAAPQVVPAFAS

SEQ ID NO: 1554 - protein, 14 aa, Mus sp.
NHTLFHNPHVNPLP

SEQ ID NO: 1555 - protein, 16 aa, Mus sp.
LPYVQYFGGVSALSKQ

SEQ ID NO: 1556 - protein, 21 aa, Mus sp.
RKGEQIYYAGPVNNPGLDVPQ

SEQ ID NO: 1557 - protein, 19 aa, Mus sp.
EPPPAYEPPAPAPAPLPPP

SEQ ID NO: 1558 - protein, 15 aa, Mus sp.
EDYVQSMDVAAFNKI

SEQ ID NO: 1559 - protein, 19 aa, Mus sp.
APMPPIIHAPRINVVPMPP

SEQ ID NO: 1560 - protein, 13 aa, Mus sp.
KSKYKASIAALEA

SEQ ID NO: 1561 - protein, 14 aa, Mus sp.
KKAGYITPVPGGVG

SEQ ID NO: 1562 - protein, 14 aa, Mus sp.
GDDWTIFQSNHSTY

SEQ ID NO: 1563 - protein, 14 aa, Mus sp.
TPYYVAPEVLGPEK

SEQ ID NO: 1564 - protein, 16 aa, Listeria monocytogenes
KEKVVATPVSNVSTSS

SEQ ID NO: 1565 - protein, 19 aa, Mus sp.
SFSGALGVPSFVVPSSGPG

SEQ ID NO: 1566 - protein, 14 aa, Mus sp.
FETFNTPAMYVAIQ

SEQ ID NO: 1567 - protein, 14 aa, BOVIN
VVVGPSVVAVPLPL

SEQ ID NO: 1568 - protein, 15 aa, Mus sp.
KELEEQLGPVAEETR

SEQ ID NO: 1569 - protein, 15 aa, Mus sp.
EWKFTITPPSAQVVG

SEQ ID NO: 1570 - protein, 25 aa, Mus sp.
LPGVPPGLEFLVQIDQILIHQKAER

SEQ ID NO: 1571 - protein, 19 aa, Mus sp.
EQPGLNGAAAAAAAEAPDE

SEQ ID NO: 1572 - protein, 16 aa, Mus sp.
KVSDYISPLLSFAAEH

SEQ ID NO: 1573 - protein, 19 aa, Mus sp.
APGRDLHYQNPHSNAVGNP

SEQ ID NO: 1574 - protein, 18 aa, Mus sp.
NHIEVWERPLSNLAWAVA

SEQ ID NO: 1575 - protein, 15 aa, Mus sp.
SVTYYGPSGQKTIYS

SEQ ID NO: 1576 - protein, 18 aa, Mus sp.
TDINAFVGAVSLTAADSN

SEQ ID NO: 1577 - protein, 18 aa, Mus sp.
DGVPVPGSPFPLEAVAPT

SEQ ID NO: 1578 - protein, 19 aa, Mus sp.
LTGMAFRVPTPNVSVVDLT

SEQ ID NO: 1579 - protein, 15 aa, Mus sp.
RNYEYYASHVPESVK

SEQ ID NO: 1580 - protein, 15 aa, Mus sp.
SEEEYSAPLPTPAPS

SEQ ID NO: 1581 - protein, 15 aa, Listeria monocytogenes
ERWNEKYAQAYPNVS

SEQ ID NO: 1582 - protein, 15 aa, Mus sp.
NSEFDPPGPNVATTT

SEQ ID NO: 1583 - protein, 29 aa, Mus sp.
GGLDSLIGDSNFGAPSASVAAAPAPARLG

SEQ ID NO: 1584 - protein, 14 aa, Mus sp.
FTITPPSAQVVGVL

SEQ ID NO: 1585 - protein, 15 aa, Mus sp.
VVIEVFTPVVQRILK

SEQ ID NO: 1586 - protein, 20 aa, Mus sp.
APSNYLNNPYVRKALHIPES

SEQ ID NO: 1587 - protein, 17 aa, Mus sp.
VGTIRYMAPEVLEGAVN

SEQ ID NO: 1588 - protein, 17 aa, Mus sp.
LLEAKGPVTDVAYSHDG

SEQ ID NO: 1589 - protein, 15 aa, Mus sp.
ADHFEIRFPLALDVK

SEQ ID NO: 1590 - protein, 15 aa, Mus sp.
ELPDIAPPLVTPDEP

SEQ ID NO: 1591 - protein, 12 aa, Mus sp.
YTIPFYTPIPNG

SEQ ID NO: 1592 - protein, 15 aa, Mus sp.
DRQVWSGSKAAGAPP

SEQ ID NO: 1593 - protein, 13 aa, Mus sp.
KPFQNPVPNQSPS

SEQ ID NO: 1594 - protein, 20 aa, Mus sp.
GFPKPPSYNVATTLPSYDEA

SEQ ID NO: 1595 - protein, 15 aa, Mus sp.
SPVFSPANPESSIED

SEQ ID NO: 1596 - protein, 14 aa, Mus sp.
LSYAVSWAKVSESG

SEQ ID NO: 1597 - protein, 19 aa, Mus sp.
KPADITDVVKPIALPTEEP

SEQ ID NO: 1598 - protein, 14 aa, Mus sp.
VIHFNNPKVQASLA

SEQ ID NO: 1599 - protein, 15 aa, Mus sp.
KFRFEEPVVLPDLSD

SEQ ID NO: 1600 - protein, 14 aa, Mus sp.
YASWAANQINRAYQ

SEQ ID NO: 1601 - protein, 15 aa, Mus sp.
GEVEWKGPWSDSSYE

SEQ ID NO: 1602 - protein, 13 aa, Mus sp.
QIDYTVPTVIAEE

SEQ ID NO: 1603 - protein, 18 aa, Mus sp.
FPPEFYEHAKALWEDEGV

SEQ ID NO: 1604 - protein, 15 aa, Mus sp.
EEDWTISPVPQSIVD

SEQ ID NO: 1605 - protein, 16 aa, Mus sp.
KEVDRYDAPGIAFYPG

SEQ ID NO: 1606 - protein, 17 aa, Mus sp.
NPDEAVAYGAAVQAAIL

SEQ ID NO: 1607 - protein, 19 aa, Mus sp.
TPPSPKVTYKAPVPTGEVY

SEQ ID NO: 1608 - protein, 16 aa, Mus sp.
NSEVYHEPHIADAWPQ

SEQ ID NO: 1609 - protein, 20 aa, Mus sp.
SPTSPSYSPTSPNYSPTSPN

SEQ ID NO: 1610 - protein, 18 aa, Mus sp.
DFVAWATGEPNFANDDEN

SEQ ID NO: 1611 - protein, 15 aa, Mus sp.
NPDFTQPISEVVDEV

SEQ ID NO: 1612 - protein, 15 aa, Mus sp.
FVEEFIWPAVQSSAL

SEQ ID NO: 1613 - protein, 12 aa, Mus sp.
IVKYELPLVIKA

SEQ ID NO: 1614 - protein, 15 aa, Mus sp.
REGSYEAAKILLDHF

SEQ ID NO: 1615 - protein, 15 aa, Mus sp.
YYLPYKSPGINVDSS

SEQ ID NO: 1616 - protein, 17 aa, Mus sp.
HWGEWSPAHPLEAEDTR

SEQ ID NO: 1617 - protein, 13 aa, Mus sp.
AEQEVLAPQVVLS

SEQ ID NO: 1618 - protein, 17 aa, Mus sp.
ITKQEYDEAGPSIVHRK

SEQ ID NO: 1619 - protein, 17 aa, Mus sp.
DYVELPPSVSQAAKSPP

SEQ ID NO: 1620 - protein, 21 aa, Mus sp.
GPEAPLDELVGAYPNYNEEEE

SEQ ID NO: 1621 - protein, 16 aa, Mus sp.
FSPYAAPSPQGSYQPS

SEQ ID NO: 1622 - protein, 15 aa, Mus sp.
SPNYAAPEVISGRLY

SEQ ID NO: 1623 - protein, 15 aa, Mus sp.
NLRDNYRFAHTNIES

SEQ ID NO: 1624 - protein, 14 aa, Mus sp.
VGDIFSNPEAVLAK

SEQ ID NO: 1625 - protein, 13 aa, Mus sp.
VQPYSGSPANLAA

SEQ ID NO: 1626 - protein, 13 aa, Mus sp.
ELWDSPEPASAPR

SEQ ID NO: 1627 - protein, 15 aa, Mus sp.
VSVEFIAPTLEGTYT

SEQ ID NO: 1628 - protein, 14 aa, Mus sp.
EALVGPEANVGPYG

SEQ ID NO: 1629 - protein, 12 aa, Mus sp.
DIFIGPKAEEHR

SEQ ID NO: 1630 - protein, 13 aa, Mus sp.
DKEFHAPLIIDEN

SEQ ID NO: 1631 - protein, 17 aa, Mus sp.
DVPFTLAPHVLAAQGTI

SEQ ID NO: 1632 - protein, 15 aa, Mus sp.
FPDNYNSPTPYKIQY

SEQ ID NO: 1633 - protein, 16 aa, Mus sp.
GDISISGPKVNVEAPN

SEQ ID NO: 1634 - protein, 17 aa, Mus sp.
ADKTVKGPDGLTALEAT

SEQ ID NO: 1635 - protein, 18 aa, Mus sp.
NRITPSYVAFTPEGERLI

SEQ ID NO: 1636 - protein, 16 aa, Mus sp.
VPSVIYTHPEVAWVGK

SEQ ID NO: 1637 - protein, 15 aa, Mus sp.
TEDNVFEAPTLVKVF

SEQ ID NO: 1638 - protein, 14 aa, Mus sp.
LSYNEPLSLKTEAF

SEQ ID NO: 1639 - protein, 20 aa, Mus sp.
GPNDERFGVRFPAMSDAYDR

SEQ ID NO: 1640 - protein, 21 aa, Mus sp.
DPETSVLILRKPGVSVASDWS

SEQ ID NO: 1641 - protein, 21 aa, Mus sp.
AFLGGGAPGSRHPGGGDYEEL

SEQ ID NO: 1642 - protein, 16 aa, Mus sp.
APMYYRGSAAAIIVYD

SEQ ID NO: 1643 - protein, 15 aa, Mus sp.
HIPEFQLPHLSHTIE

SEQ ID NO: 1644 - protein, 18 aa, Mus sp.
INRLDNYDAPDIANIAIS

SEQ ID NO: 1645 - protein, 15 aa, Mus sp.
VDVFYSSGIPATARP

SEQ ID NO: 1646 - protein, 16 aa, Mus sp.
DPNTAYASYPSASVEN

SEQ ID NO: 1647 - protein, 12 aa, Mus sp.
HTLFHNPHVNPL

SEQ ID NO: 1648 - protein, 14 aa, Mus sp.
IFYGASIASLSASH

SEQ ID NO: 1649 - protein, 14 aa, Mus sp.
RTVITPDPNLSIDQ

SEQ ID NO: 1650 - protein, 16 aa, Mus sp.
VPFWAHAGNAIPSADQ

SEQ ID NO: 1651 - protein, 15 aa, Mus sp.
VTDYYTLPIGIRTVA

SEQ ID NO: 1652 - protein, 14 aa, Mus sp.
YYLPYKSPGINVDS

SEQ ID NO: 1653 - protein, 14 aa, Mus sp.
DVDFDFAGPAIHGS

SEQ ID NO: 1654 - protein, 14 aa, Mus sp.
LPNYSSPNALVLNT

SEQ ID NO: 1655 - protein, 15 aa, Mus sp.
DVDFDFAGPAIHGSA

SEQ ID NO: 1656 - protein, 17 aa, Mus sp.
GTPEYLAPEVLEDNDYG

SEQ ID NO: 1657 - protein, 14 aa, Mus sp.
AGNFYVPAEPKLAF

SEQ ID NO: 1658 - protein, 14 aa, Mus sp.
IQWESSRPLLASIE

SEQ ID NO: 1659 - protein, 17 aa, Mus sp.
LDDNVFVPPESLQEEDE

SEQ ID NO: 1660 - protein, 14 aa, Mus sp.
EALFYNHALPLPGF

SEQ ID NO: 1661 - protein, 19 aa, Mus sp.
GLNVLRIINEPTAAAIAYG

SEQ ID NO: 1662 - protein, 11 aa, Mus sp.
PKISTSLPVLD

SEQ ID NO: 1663 - protein, 15 aa, Mus sp.
GSPNYAAPEVISGRL

SEQ ID NO: 1664 - protein, 18 aa, Mus sp.
VDKDQSIAPKTTRVTYPA

SEQ ID NO: 1665 - protein, 13 aa, Mus sp.
RTWNDPSVQQDIK

SEQ ID NO: 1666 - protein, 15 aa, Mus sp.
INDIIRAPTIEQMKD

SEQ ID NO: 1667 - protein, 22 aa, Mus sp.
AVNKGFYKEATQLWGKAEMIIE

SEQ ID NO: 1668 - protein, 14 aa, Mus sp.
YVTQFHPPHIEIQM

SEQ ID NO: 1669 - protein, 16 aa, Mus sp.
VPVPGSPFPLEAVAPT

SEQ ID NO: 1670 - protein, 17 aa, Mus sp.
LPRSQYDYVLPQVSFTA

SEQ ID NO: 1671 - protein, 16 aa, Mus sp.
NINQWTASIVEQSITH

SEQ ID NO: 1672 - protein, 18 aa, Mus sp.
DSPDVVYSPETIEARYEY

SEQ ID NO: 1673 - protein, 19 aa, Mus sp.
KPKGQLPDYTSPVVLPYSR

SEQ ID NO: 1674 - protein, 16 aa, Mus sp.
ADPSAFAAAAPAAAAT

SEQ ID NO: 1675 - protein, 16 aa, Mus sp.
VPDDLLYSFPVVIKNK

SEQ ID NO: 1676 - protein, 15 aa, Mus sp.
YTWSSRGPSADGALG

SEQ ID NO: 1677 - protein, 14 aa, Mus sp.
NQLEALVGPEANVG

SEQ ID NO: 1678 - protein, 16 aa, Mus sp.
SPDVVYSPETIEARYE

SEQ ID NO: 1679 - protein, 16 aa, Mus sp.
GRPDAEYWNSQPEILE

SEQ ID NO: 1680 - protein, 15 aa, Mus sp.
FDYSGSQAIKALKEE

SEQ ID NO: 1681 - protein, 18 aa, Mus sp.
TPAAPTSALGPKASPAPS

SEQ ID NO: 1682 - protein, 18 aa, Mus sp.
DGNHTLFHNPHVNPLPTG

SEQ ID NO: 1683 - protein, 14 aa, Mus sp.
EVYHEPHIADAWPQ

SEQ ID NO: 1684 - protein, 17 aa, Mus sp.
VSTLIWAAPRLQSEVAE

SEQ ID NO: 1685 - protein, 13 aa, Mus sp.
DAEYWNSQPEILE

SEQ ID NO: 1686 - protein, 22 aa, Mus sp.
MEKIQASVATNPIITPVAQENQ

SEQ ID NO: 1687 - protein, 17 aa, Mus sp.
THDLDFRAPHVLVLGSG

SEQ ID NO: 1688 - protein, 14 aa, Mus sp.
KEDRRYNPPIIHQG

SEQ ID NO: 1689 - protein, 17 aa, Mus sp.
APSNTFVAPQPVVASPA

SEQ ID NO: 1690 - protein, 22 aa, Mus sp.
AIEDDSGRETDSSSAPAVTPSK

SEQ ID NO: 1691 - protein, 16 aa, Mus sp.
DPDFLRTAVAQVIGDR

SEQ ID NO: 1692 - protein, 13 aa, Mus sp.
FPYEGPAPLEAIA

SEQ ID NO: 1693 - protein, 15 aa, Mus sp.
AEDVTFIGPDTHAIQ

SEQ ID NO: 1694 - protein, 16 aa, Mus sp.
RTDWEAPTGQPSAPGP

SEQ ID NO: 1695 - protein, 15 aa, Mus sp.
KPPSYNVATTLPSYD

SEQ ID NO: 1696 - protein, 20 aa, Mus sp.
EGPEVDVSLPKANIDVSGPK

SEQ ID NO: 1697 - protein, 17 aa, Mus sp.
ETELDQLFSGPLPGRLP

SEQ ID NO: 1698 - protein, 13 aa, Mus sp.
VNSQYQEPDIIIH

SEQ ID NO: 1699 - protein, 15 aa, Mus sp.
DDDVYRAPPIDRSIL

SEQ ID NO: 1700 - protein, 13 aa, Mus sp.
ELDYYDSPSVNAR

SEQ ID NO: 1701 - protein, 14 aa, Mus sp.
GQDHVDFSQPEPHT

SEQ ID NO: 1702 - protein, 12 aa, Mus sp.
VFVAPAVTPVKG

SEQ ID NO: 1703 - protein, 14 aa, Mus sp.
AGGHKLGLALELEA

SEQ ID NO: 1704 - protein, 13 aa, Mus sp.
VEGYEGSAASIST

SEQ ID NO: 1705 - protein, 17 aa, Mus sp.
YVELPPSVSQAATSPPG

SEQ ID NO: 1706 - protein, 13 aa, Mus sp.
ATNPIITPVAQEN

SEQ ID NO: 1707 - protein, 12 aa, Mus sp.
ALKPEYVAPLVL

SEQ ID NO: 1708 - protein, 16 aa, Mus sp.
LPQDPTFHTPLDLYAY

SEQ ID NO: 1709 - protein, 17 aa, Mus sp.
KKWVNTPFTASSIELVP

SEQ ID NO: 1710 - protein, 16 aa, Mus sp.
FNPGDASGPEAAGSPP

SEQ ID NO: 1711 - protein, 17 aa, Mus sp.
GTVDVVLTPLVAEALDR

SEQ ID NO: 1712 - protein, 13 aa, Mus sp.
DLWGPGARVAADS

SEQ ID NO: 1713 - protein, 23 aa, Mus sp.
LPNKPTVTVVSPLPNDSINPQPS

SEQ ID NO: 1714 - protein, 15 aa, Mus sp.
KFLPNAPKALIVEPS

SEQ ID NO: 1715 - protein, 19 aa, Mus sp.
KGQDHVDFSQPEPHTVLFH

SEQ ID NO: 1716 - protein, 14 aa, Mus sp.
SNPSYNYEIVNRAS

SEQ ID NO: 1717 - protein, 18 aa, Mus sp.
GPDGRFVMGPTVAPSQEK

SEQ ID NO: 1718 - protein, 15 aa, Mus sp.
MYKVHNPVPLIVGSS

SEQ ID NO: 1719 - protein, 13 aa, Mus sp.
HDLDFRAPHVLVL

SEQ ID NO: 1720 - protein, 17 aa, Mus sp.
GPKVNVEAPNVNMEGLG

SEQ ID NO: 1721 - protein, 20 aa, Mus sp.
APAATDEAAASAAPAASPEP

SEQ ID NO: 1722 - protein, 23 aa, Mus sp.
GPSAPATPAAEAKAAEAAASAYY

SEQ ID NO: 1723 - protein, 16 aa, Mus sp.
QPPTGYSTPTAPQAYS

SEQ ID NO: 1724 - protein, 13 aa, Mus sp.
TPYYVAPEVLGPE

SEQ ID NO: 1725 - protein, 15 aa, Mus sp.
GTVIHFNNPKVQASL

SEQ ID NO: 1726 - protein, 17 aa, Mus sp.
VEPGNFIAATSLYSPER

SEQ ID NO: 1727 - protein, 19 aa, Mus sp.
DGTVPFWAHAGNAIPSADQ

SEQ ID NO: 1728 - protein, 17 aa, Mus sp.
MPDMHFKTPKISMPDID

SEQ ID NO: 1729 - protein, 16 aa, Mus sp.
ISKQEYDESGPSIVHR

SEQ ID NO: 1730 - protein, 14 aa, Mus sp.
RDNMFSGSKINYTE

SEQ ID NO: 1731 - protein, 16 aa, Mus sp.
SNPSYNYEIVNRASLA

SEQ ID NO: 1732 - protein, 15 aa, Mus sp.
VGTKRYMAPEVLDDS

SEQ ID NO: 1733 - protein, 16 aa, Mus sp.
DPTTAFQAPDVGQALL

SEQ ID NO: 1734 - protein, 18 aa, Mus sp.
TPRVLSQAPSPLYSVEFS

SEQ ID NO: 1735 - protein, 17 aa, Mus sp.
DVDFDFAGPAIHGSAVF

SEQ ID NO: 1736 - protein, 16 aa, Mus sp.
LDKEIYYHGEPISVNV

SEQ ID NO: 1737 - protein, 8 aa, Mus sp.
PKISTSLP

SEQ ID NO: 1738 - protein, 11 aa, Mus sp.
RYMAPEVLDDS

SEQ ID NO: 1739 - protein, 12 aa, Mus sp.
LPYKSPGINVDS

SEQ ID NO: 1740 - protein, 15 aa, Mus sp.
FVNYSNAVTLHLGNN

SEQ ID NO: 1741 - protein, 17 aa, Mus sp.
FADDTYTESYISTIGVD

SEQ ID NO: 1742 - protein, 14 aa, Mus sp.
EVWERPLSNLAWAV

SEQ ID NO: 1743 - protein, 15 aa, Mus sp.
FSYAVFGPRVASGDL

SEQ ID NO: 1744 - protein, 17 aa, Mus sp.
APINAFIGGLAAQEVMK

SEQ ID NO: 1745 - protein, 18 aa, Mus sp.
KVGGERFEAPEALFQPHL

SEQ ID NO: 1746 - protein, 14 aa, Mus sp.
DRRYNPPIIHQGFQ

SEQ ID NO: 1747 - protein, 13 aa, Mus sp.
SSIYYISSTIAYA

SEQ ID NO: 1748 - protein, 13 aa, Mus sp.
DAYHFFSPEPLNS

SEQ ID NO: 1749 - protein, 15 aa, Mus sp.
GSVTYIAPPGNYDAS

SEQ ID NO: 1750 - protein, 15 aa, Mus sp.
RESKVVVPPLPGKAF

SEQ ID NO: 1751 - protein, 13 aa, Mus sp.
DYVPPTANLDQKD

SEQ ID NO: 1752 - protein, 15 aa, Mus sp.
APVPSPVAPAPVPSR

SEQ ID NO: 1753 - protein, 14 aa, Mus sp.
DSKIVVPPLPGKAL

SEQ ID NO: 1754 - protein, 14 aa, Mus sp.
SPDVVYSPETIEAR

SEQ ID NO: 1755 - protein, 14 aa, Mus sp.
RNIYWTDSVPGSVS

SEQ ID NO: 1756 - protein, 16 aa, Mus sp.
LIGRTWNDPSVQQDIK

SEQ ID NO: 1757 - protein, 13 aa, Mus sp.
GDSERHFVYQFMG

SEQ ID NO: 1758 - protein, 15 aa, Mus sp.
KIGEHTPSALAIMEN

SEQ ID NO: 1759 - protein, 15 aa, Mus sp.
GFPYEGPAPLEAIAN

SEQ ID NO: 1760 - protein, 17 aa, Mus sp.
LPDDINVYATTAANPKE

SEQ ID NO: 1761 - protein, 18 aa, Mus sp.
VIEDRDHYIPNTLNPVFG

SEQ ID NO: 1762 - protein, 16 aa, Mus sp.
EAINDYKGAVIVVSHD

SEQ ID NO: 1763 - protein, 12 aa, Mus sp.
VEPYEVHNPVPL

SEQ ID NO: 1764 - protein, 14 aa, Mus sp.
DTVTISGPQAAVNE

SEQ ID NO: 1765 - protein, 15 aa, Mus sp.
NYEYYASHVPESVKN

SEQ ID NO: 1766 - protein, 16 aa, Mus sp.
SFVNIVERDRTLGYQE

SEQ ID NO: 1767 - protein, 18 aa, Mus sp.
EQIYYAGPVNNPGLDVPQ

SEQ ID NO: 1768 - protein, 16 aa, Mus sp.
KGPAFVNPLIPENKEE

SEQ ID NO: 1769 - protein, 14 aa, Mus sp.
SEVYTFPVPERHLE

SEQ ID NO: 1770 - protein, 13 aa, Mus sp.
APYQGPDAAPGAL

SEQ ID NO: 1771 - protein, 19 aa, Mus sp.
GNRITPSYVAFTPEGERLI

SEQ ID NO: 1772 - protein, 21 aa, Mus sp.
GKLTGMAFRVPTPNVSVVDLT

SEQ ID NO: 1773 - protein, 14 aa, Listeria monocytogenes
IAVTAFAAPTIASA

SEQ ID NO: 1774 - protein, 15 aa, Mus sp.
DMDGEWEAPQIANPK

SEQ ID NO: 1775 - protein, 14 aa, Mus sp.
TLPDFHVPEITIPE

SEQ ID NO: 1776 - protein, 17 aa, Mus sp.
SPNKLYTLVTYVPVTTF

SEQ ID NO: 1777 - protein, 17 aa, Mus sp.
YDPDFLRTAVAQVIGDR

SEQ ID NO: 1778 - protein, 23 aa, Mus sp.
GIKADKADKAAASGPASASAPAA

SEQ ID NO: 1779 - protein, 14 aa, Mus sp.
LDYWTYPGSLTTPP

SEQ ID NO: 1780 - protein, 15 aa, Mus sp.
SLVSWVGSEPMPEAG

SEQ ID NO: 1781 - protein, 18 aa, Mus sp.
TKNLDYVATSIHEAVTKI

SEQ ID NO: 1782 - protein, 15 aa, Mus sp.
LPENFRRPQTDQAVE

SEQ ID NO: 1783 - protein, 14 aa, Mus sp.
NLDYVATSIHEAVT

SEQ ID NO: 1784 - protein, 17 aa, Mus sp.
TQSSCYISQLMFFMKSP

SEQ ID NO: 1785 - protein, 16 aa, Mus sp.
YLPETFRRPQIDPAVE

SEQ ID NO: 1786 - protein, 13 aa, Mus sp.
LEEQLGPVAEETR

SEQ ID NO: 1787 - protein, 17 aa, Mus sp.
DTNLNDLGPRALEIYRA

SEQ ID NO: 1788 - protein, 14 aa, Mus sp.
GSPYIAAKINEAKD

SEQ ID NO: 1789 - protein, 15 aa, Mus sp.
RAAFYHQPWAQEAVG

SEQ ID NO: 1790 - protein, 15 aa, Mus sp.
YLNEYGAPDAGGLEH

SEQ ID NO: 1791 - protein, 14 aa, Mus sp.
VEYHFLSPYVSPRE

SEQ ID NO: 1792 - protein, 16 aa, Mus sp.
DGYPVLYPTGWSSSDN

SEQ ID NO: 1793 - protein, 16 aa, Mus sp.
MPDMHFKAPKISMPDV

SEQ ID NO: 1794 - protein, 16 aa, Mus sp.
KVEPYEVHNPVPLIVG

SEQ ID NO: 1795 - protein, 16 aa, Mus sp.
SPVDFHTPSSPKSPPS

SEQ ID NO: 1796 - protein, 15 aa, Mus sp.
MAPYQGPDAAPGALD

SEQ ID NO: 1797 - protein, 17 aa, Mus sp.
EQIYYAGPVNNPGLDVP

SEQ ID NO: 1798 - protein, 17 aa, Mus sp.
GDSNFGAPSASVAAAPA

SEQ ID NO: 1799 - protein, 16 aa, Mus sp.
SVYTRYHCSLPVPEPS

SEQ ID NO: 1800 - protein, 15 aa, Mus sp.
FDIFYTAPQPGKYVI

SEQ ID NO: 1801 - protein, 16 aa, Mus sp.
TPEYLAPEVLEDNDYG

SEQ ID NO: 1802 - protein, 16 aa, Mus sp.
AVKSKYKASIAALEAK

SEQ ID NO: 1803 - protein, 18 aa, Mus sp.
WSDAAAPFAGLSTDQTLR

SEQ ID NO: 1804 - protein, 20 aa, Mus sp.
TPSSPSYSPSSPSYSPTSPK

SEQ ID NO: 1805 - protein, 17 aa, Mus sp.
APAAAEAPAAAEAPAPA

SEQ ID NO: 1806 - protein, 16 aa, Mus sp.
IPQAERYQEALPTVAN

SEQ ID NO: 1807 - protein, 16 aa, Mus sp.
GPGDGYGYPRAQHVLS

SEQ ID NO: 1808 - protein, 14 aa, Mus sp.
RLEQPNVVISLSRT

SEQ ID NO: 1809 - protein, 14 aa, Mus sp.
LDYFKGAIPIRKLV

SEQ ID NO: 1810 - protein, 17 aa, Mus sp.
GKKFTAPHILIATGGVP

SEQ ID NO: 1811 - protein, 16 aa, Mus sp.
VLPTYDASKVTASGPG

SEQ ID NO: 1812 - protein, 21 aa, Mus sp.
TPSPTPENEDLHAATVNPDPS

SEQ ID NO: 1813 - protein, 20 aa, Mus sp.
DPAGPNFEYAEAPSRLSPDD

SEQ ID NO: 1814 - protein, 15 aa, Mus sp.
LPVKWTAPEALREKK

SEQ ID NO: 1815 - protein, 18 aa, Mus sp.
TGMAFRVPTPNVSVVDLT

SEQ ID NO: 1816 - protein, 15 aa, Mus sp.
IPISKVKDVYVITDQ

SEQ ID NO: 1817 - protein, 16 aa, Mus sp.
VEPYEVHNPVPLIVGS

SEQ ID NO: 1818 - protein, 14 aa, Mus sp.
TPWKAPIVWEGTYD

SEQ ID NO: 1819 - protein, 13 aa, Mus sp.
DPAWEAPEGVPID

SEQ ID NO: 1820 - protein, 17 aa, Mus sp.
VPSVIYTHPEVAWVGKS

SEQ ID NO: 1821 - protein, 15 aa, Mus sp.
IPKVVKSPSSLPAKP

SEQ ID NO: 1822 - protein, 14 aa, Mus sp.
KQLTYTYPLVYDHK

SEQ ID NO: 1823 - protein, 23 aa, Mus sp.
DVDFEGVKKKAGYITPVPGGVGP

SEQ ID NO: 1824 - protein, 21 aa, Mus sp.
DQGNRITPSYVAFTPEGERLI

SEQ ID NO: 1825 - protein, 15 aa, Mus sp.
LPETFRRPQIDPAVE

SEQ ID NO: 1826 - protein, 14 aa, Mus sp.
FPDNYNSPTPYKIQ

SEQ ID NO: 1827 - protein, 17 aa, Mus sp.
SKPSFHAPEPKPHYDPA

SEQ ID NO: 1828 - protein, 17 aa, Mus sp.
LHQALKMLWQNLHQFGQ

SEQ ID NO: 1829 - protein, 25 aa, Mus sp.
DAGTIAGLNVMRIINEPTAAAIAYG

SEQ ID NO: 1830 - protein, 16 aa, Mus sp.
TSDIFGSPVTATAPLA

SEQ ID NO: 1831 - protein, 21 aa, Mus sp.
EPSPVSETVVTPEAAPEKNPV

SEQ ID NO: 1832 - protein, 18 aa, Mus sp.
VPYVEKYRPASASVSALI

SEQ ID NO: 1833 - protein, 19 aa, Mus sp.
EEVGEYRQPSGGSVPVSPG

SEQ ID NO: 1834 - protein, 16 aa, Mus sp.
SIKEKYNSFWIGLSYT

SEQ ID NO: 1835 - protein, 13 aa, Mus sp.
DPYDQPNAIYIER

SEQ ID NO: 1836 - protein, 16 aa, Mus sp.
VGGERFEAPEALFQPH

SEQ ID NO: 1837 - protein, 16 aa, Mus sp.
ITPSYYTTSDAVISTE

SEQ ID NO: 1838 - protein, 18 aa, Mus sp.
APPLPIKTPIPTPSTLPA

SEQ ID NO: 1839 - protein, 25 aa, Mus sp.
GPGEPSPVSETVVTPEAAPEKNPVD

SEQ ID NO: 1840 - protein, 18 aa, Mus sp.
DVKKPAAAPAPAPAPAPA

SEQ ID NO: 1841 - protein, 16 aa, Mus sp.
LKPVWYSPKVFIEGAD

SEQ ID NO: 1842 - protein, 26 aa, Mus sp.
APAPAAPAAAEPQAEAPAAAASSEQS

SEQ ID NO: 1843 - protein, 13 aa, Mus sp.
APDTRFVAPGALG

SEQ ID NO: 1844 - protein, 17 aa, Mus sp.
KNLDYVATSIHEAVTKI

SEQ ID NO: 1845 - protein, 15 aa, Mus sp.
INPDNVATPIAASLG

SEQ ID NO: 1846 - protein, 22 aa, Mus sp.
VPPGLEFLVQIDQILIHQKAER

SEQ ID NO: 1847 - protein, 12 aa, Listeria monocytogenes
EVVYHNMKQDLE

SEQ ID NO: 1848 - protein, 17 aa, Mus sp.
TAKGLFRAAVPSGASTG

SEQ ID NO: 1849 - protein, 15 aa, Mus sp.
YYNEVHSPSVAVEMG

SEQ ID NO: 1850 - protein, 16 aa, Mus sp.
EQEVLAPQVVLSLGGS

SEQ ID NO: 1851 - protein, 16 aa, Mus sp.
APKETTIWVSPSPILE

SEQ ID NO: 1852 - protein, 19 aa, Mus sp.
GEQIYYAGPVNNPGLDVPQ

SEQ ID NO: 1853 - protein, 15 aa, Mus sp.
DDIRSDWTNPEINKA

SEQ ID NO: 1854 - protein, 17 aa, Mus sp.
EGPEASTPMPSPSPSPS

SEQ ID NO: 1855 - protein, 17 aa, Mus sp.
EATRYLAPTILTDVDPN

SEQ ID NO: 1856 - protein, 14 aa, Mus sp.
TPEFLAPEVLTDTS

SEQ ID NO: 1857 - protein, 13 aa, Mus sp.
AVDVFFPPEAQND

SEQ ID NO: 1858 - protein, 15 aa, Mus sp.
KFVYAGSNSGVVQAP

SEQ ID NO: 1859 - protein, 16 aa, Mus sp.
IEEVYYDHLRCAFKSP

SEQ ID NO: 1860 - protein, 16 aa, Mus sp.
LNLDWQYPGSRGSPPK

SEQ ID NO: 1861 - protein, 19 aa, Mus sp.
AAPAPAAAPAAAPAAAPEP

SEQ ID NO: 1862 - protein, 20 aa, Mus sp.
DPEDHTVSFVQPNGAIFEPS

SEQ ID NO: 1863 - protein, 14 aa, Mus sp.
EDVTFIGPDTHAIQ

SEQ ID NO: 1864 - protein, 16 aa, Mus sp.
KFRFEEPVVLPDLSDQ

SEQ ID NO: 1865 - protein, 10 aa, Mus sp.
TPDYIAPEII

SEQ ID NO: 1866 - protein, 20 aa, Mus sp.
EQRATFHTPEAPPNLAPAPP

SEQ ID NO: 1867 - protein, 14 aa, Mus sp.
GDLSWHPALTTKSK

SEQ ID NO: 1868 - protein, 30 aa, Mus sp.
KKVNRITGLDPAGPNFEYAEAPSRLSPDDA

SEQ ID NO: 1869 - protein, 13 aa, Mus sp.
LRDNYRFAHTNIE

SEQ ID NO: 1870 - protein, 21 aa, Mus sp.
GDSVTTDHISPAGNIARNSPA

SEQ ID NO: 1871 - protein, 16 aa, Mus sp.
GEPYMYLSPLQQAVSD

SEQ ID NO: 1872 - protein, 11 aa, Mus sp.
DYFKGAIPIRK

SEQ ID NO: 1873 - protein, 15 aa, Mus sp.
IASFKDPKISTSLPV

SEQ ID NO: 1874 - protein, 16 aa, Mus sp.
TNDRYVASLAARNKVG

SEQ ID NO: 1875 - protein, 17 aa, Mus sp.
EWKDYKAGFGNLEREFW

SEQ ID NO: 1876 - protein, 17 aa, Mus sp.
YPYPTDFLGPLPANPVK

SEQ ID NO: 1877 - protein, 17 aa, Mus sp.
SPLVHVLMGNVYILFPP

SEQ ID NO: 1878 - protein, 15 aa, Mus sp.
IWRDYVPPTANLDQK

SEQ ID NO: 1879 - protein, 14 aa, Mus sp.
AVNWYAPLVAPISK

SEQ ID NO: 1880 - protein, 15 aa, Mus sp.
EQFVYSSPHDNKSWE

SEQ ID NO: 1881 - protein, 18 aa, Mus sp.
TSQELVRAPTAALSPEPQ

SEQ ID NO: 1882 - protein, 16 aa, Mus sp.
VGINYQPPTVVPGGDL

SEQ ID NO: 1883 - protein, 11 aa, Mus sp.
LPDYSAPNPIK

SEQ ID NO: 1884 - protein, 15 aa, Mus sp.
GVDFIGSTVGLAKVS

SEQ ID NO: 1885 - protein, 13 aa, Mus sp.
LGEFDTPEAIWSS

SEQ ID NO: 1886 - protein, 14 aa, Mus sp.
TTSSYSNPTIGYEN

SEQ ID NO: 1887 - protein, 18 aa, Mus sp.
HPAPPVASSPTVIPGEPR

SEQ ID NO: 1888 - protein, 22 aa, Mus sp.
TPPPPPPNEISPPHAVEEEEDD

SEQ ID NO: 1889 - protein, 16 aa, Mus sp.
STDYGNFLANEASPLT

SEQ ID NO: 1890 - protein, 18 aa, Mus sp.
EAPSIFLDPETRQAMGEQ

SEQ ID NO: 1891 - protein, 14 aa, Mus sp.
LDWQYPGSRGSPPK

SEQ ID NO: 1892 - protein, 16 aa, Mus sp.
GTPGYVAPEVLAQKPY

SEQ ID NO: 1893 - protein, 16 aa, Mus sp.
SIVYWMTSQPSDAVRF

SEQ ID NO: 1894 - protein, 17 aa, Mus sp.
TPTDVTHHPIPSEEDIN

SEQ ID NO: 1895 - protein, 19 aa, Mus sp.
NFHQRFESPDSQASAEQPE

SEQ ID NO: 1896 - protein, 15 aa, Mus sp.
KWKYEKPDGSPVFIA

SEQ ID NO: 1897 - protein, 18 aa, Mus sp.
GDTIEFRGPNGLLVYQGK

SEQ ID NO: 1898 - protein, 14 aa, Mus sp.
VSWQEKQPEASISQ

SEQ ID NO: 1899 - protein, 15 aa, Mus sp.
DFITMNPSVVQRAFG

SEQ ID NO: 1900 - protein, 16 aa, Mus sp.
HFPDYRAAEVRETLNQ

SEQ ID NO: 1901 - protein, 15 aa, Mus sp.
LENPHQPASLEATDS

SEQ ID NO: 1902 - protein, 19 aa, Mus sp.
DDGTVIHFNNPKVQASLSA

SEQ ID NO: 1903 - protein, 16 aa, Mus sp.
FGPYYTEPVIAGLDPK

SEQ ID NO: 1904 - protein, 16 aa, Mus sp.
DGIEDFVSGVPRAART

SEQ ID NO: 1905 - protein, 15 aa, Mus sp.
WDRKMYYASKAMPAE

SEQ ID NO: 1906 - protein, 17 aa, Mus sp.
ELDQLFSGPLPGRLPVN

SEQ ID NO: 1907 - protein, 16 aa, Mus sp.
VPWNFHEPQPGQYEFS

SEQ ID NO: 1908 - protein, 16 aa, Mus sp.
DIRSDWTNPEINKAVL

SEQ ID NO: 1909 - protein, 19 aa, Mus sp.
ALEDPDGFSWPATLPSVYK

SEQ ID NO: 1910 - protein, 12 aa, Mus sp.
FPYVTPAPHEPV

SEQ ID NO: 1911 - protein, 16 aa, Mus sp.
LDEYLNSPLPDEIDEN

SEQ ID NO: 1912 - protein, 13 aa, Mus sp.
DIFIGPKAEEHRG

SEQ ID NO: 1913 - protein, 14 aa, Mus sp.
DPAWEAPEGVPIDA

SEQ ID NO: 1914 - protein, 15 aa, Mus sp.
VPAPATTPAPTPAPA

SEQ ID NO: 1915 - protein, 18 aa, Mus sp.
SPALVSYASSLPAQVGTI

SEQ ID NO: 1916 - protein, 14 aa, Mus sp.
FPIKWTAPEAALYG

SEQ ID NO: 1917 - protein, 16 aa, Mus sp.
WSDAAAPFAGLSTDQT

SEQ ID NO: 1918 - protein, 16 aa, Mus sp.
GPGAVEGPNPASSPDA

SEQ ID NO: 1919 - protein, 24 aa, Mus sp.
LDSLIGDSNFGAPSASVAAAPAPA

SEQ ID NO: 1920 - protein, 18 aa, Mus sp.
GYAVYETPTAHNGAKNPR

SEQ ID NO: 1921 - protein, 18 aa, Mus sp.
GPVPEFSGATVERVSEDM

SEQ ID NO: 1922 - protein, 15 aa, Mus sp.
NVDPFKAVDTNRASM

SEQ ID NO: 1923 - protein, 14 aa, Mus sp.
TAPEYYAPEVHQHD

SEQ ID NO: 1924 - protein, 17 aa, Mus sp.
ATIQWWNMPSPNVDPYD

SEQ ID NO: 1925 - protein, 15 aa, Mus sp.
AELQTLAPAINWLPF

SEQ ID NO: 1926 - protein, 14 aa, Mus sp.
GNVYIHPTAKVAPS

SEQ ID NO: 1927 - protein, 14 aa, Mus sp.
TSSYYRGAHGIIVV

SEQ ID NO: 1928 - protein, 16 aa, Mus sp.
EGNTWLTAFVLKSFAQ

SEQ ID NO: 1929 - protein, 18 aa, Mus sp.
LPKEELYMPPLVIKVIDH

SEQ ID NO: 1930 - protein, 14 aa, Mus sp.
LVHIFKPDVSPNFG

SEQ ID NO: 1931 - protein, 17 aa, Mus sp.
APDTRFVAPGALGNAPW

SEQ ID NO: 1932 - protein, 16 aa, Mus sp.
SLKYHFVTPLTSMVVT

SEQ ID NO: 1933 - protein, 21 aa, Mus sp.
RPHDTSLVSWVGSEPMPEAGL

SEQ ID NO: 1934 - protein, 18 aa, Mus sp.
GPGSAVSPYPSFNVSSDV

SEQ ID NO: 1935 - protein, 14 aa, Mus sp.
KRYMAPEVLDDSIN

SEQ ID NO: 1936 - protein, 16 aa, Mus sp.
GTKRYMAPEVLDETIN

SEQ ID NO: 1937 - protein, 15 aa, Mus sp.
QYPNFAGPQAALANK

SEQ ID NO: 1938 - protein, 17 aa, Mus sp.
VRIDQYQGADAVGLEEK

SEQ ID NO: 1939 - protein, 17 aa, Mus sp.
EDWPTFLNPNVDKAGPA

SEQ ID NO: 1940 - protein, 16 aa, Mus sp.
YPDSWSTPHSYFSLKF

SEQ ID NO: 1941 - protein, 16 aa, Mus sp.
TLPPVSPPKAALSVDE

SEQ ID NO: 1942 - protein, 15 aa, Mus sp.
NVQFSSPLPGEAVKD

SEQ ID NO: 1943 - protein, 17 aa, Mus sp.
KILDMFVNPTSSLAYFN

SEQ ID NO: 1944 - protein, 17 aa, Mus sp.
AKQIVWNGPVGVFEWEA

SEQ ID NO: 1945 - protein, 14 aa, Mus sp.
LDNYDAPDIANIAI

SEQ ID NO: 1946 - protein, 18 aa, Mus sp.
VLEMYKVHNPVPLIVGSS

SEQ ID NO: 1947 - protein, 28 aa, Mus sp.
NVDPFKAVDTNRASMGQASPESKGFTDL

SEQ ID NO: 1948 - protein, 15 aa, Mus sp.
EGDIFIGPKAEEHRG

SEQ ID NO: 1949 - protein, 15 aa, Mus sp.
VGTARYMAPEVLESR

SEQ ID NO: 1950 - protein, 16 aa, Mus sp.
HDLDFRAPHVLVLGSG

SEQ ID NO: 1951 - protein, 17 aa, Mus sp.
KYQNVSGFSNVNINRHS

SEQ ID NO: 1952 - protein, 16 aa, Mus sp.
SPKVTYKAPVPTGEVY

SEQ ID NO: 1953 - protein, 16 aa, Mus sp.
ADKTVKGPDGLTALEA

SEQ ID NO: 1954 - protein, 17 aa, Mus sp.
NKPEDYQGGRTGEAIVD

SEQ ID NO: 1955 - protein, 16 aa, Mus sp.
TVTPWKAPIVWEGTYD

SEQ ID NO: 1956 - protein, 14 aa, Mus sp.
RTWNDPSVQQDIKF

SEQ ID NO: 1957 - protein, 20 aa, Mus sp.
SPTSPSYSPTSPNYSPTSPS

SEQ ID NO: 1958 - protein, 16 aa, Mus sp.
LPANAFASPLQNPDNH

SEQ ID NO: 1959 - protein, 23 aa, Mus sp.
APAATDEAAASAAPAASPEPQPE

SEQ ID NO: 1960 - protein, 15 aa, Mus sp.
EDYVELPPSVSQAAK

SEQ ID NO: 1961 - protein, 15 aa, Mus sp.
GNHYFYSPYPTKTQT

SEQ ID NO: 1962 - protein, 16 aa, Mus sp.
EGPYYVKPVATTAVEG

SEQ ID NO: 1963 - protein, 14 aa, Mus sp.
FGPYYTEPVIAGLD

SEQ ID NO: 1964 - protein, 12 aa, Mus sp.
LVLDFVTPTPLG

SEQ ID NO: 1965 - protein, 15 aa, Mus sp.
EQRATFHTPEAPPNL

SEQ ID NO: 1966 - protein, 16 aa, Mus sp.
LDSQYRASAPNSHVPL

SEQ ID NO: 1967 - protein, 15 aa, Mus sp.
DNMFSGSKINYTENR

SEQ ID NO: 1968 - protein, 15 aa, Mus sp.
VDFDFAGPAIHGSAV

SEQ ID NO: 1969 - protein, 14 aa, Mus sp.
AVDVFFPPEAQNDF

SEQ ID NO: 1970 - protein, 15 aa, Mus sp.
STTEFEEPRVIDLWD

SEQ ID NO: 1971 - protein, 21 aa, Mus sp.
EEKPVPAAPVPSPVAPAPVPS

SEQ ID NO: 1972 - protein, 25 aa, Mus sp.
LSPDDADFVDVLHTFTRGSPGRSIG

SEQ ID NO: 1973 - protein, 18 aa, Mus sp.
ESKATYSTNSPVWEEAFR

SEQ ID NO: 1974 - protein, 20 aa, Mus sp.
GPPGFEDYVELPPSVSQAAK

SEQ ID NO: 1975 - protein, 15 aa, Mus sp.
REVSSVEAPSVSPAR

SEQ ID NO: 1976 - protein, 13 aa, Mus sp.
QREEYQPATPGLG

SEQ ID NO: 1977 - protein, 14 aa, Mus sp.
EDNVFEAPTLVKVF

SEQ ID NO: 1978 - protein, 15 aa, Mus sp.
IEHLYKNPQAHIEGN

SEQ ID NO: 1979 - protein, 16 aa, Mus sp.
AEQEVLAPQVVLSLGG

SEQ ID NO: 1980 - protein, 18 aa, Mus sp.
FHKLSYLTFIPSDDDIYD

SEQ ID NO: 1981 - protein, 15 aa, Mus sp.
DPKLTYHGFTLEDAA

SEQ ID NO: 1982 - protein, 15 aa, Mus sp.
NLDYVATSIHEAVTK

SEQ ID NO: 1983 - protein, 14 aa, Mus sp.
DIDSFVPSKAAPAA

SEQ ID NO: 1984 - protein, 19 aa, Mus sp.
TNNQDFRGSAGAPSVENVK

SEQ ID NO: 1985 - protein, 15 aa, Mus sp.
VPSVIYTHPEVAWVG

SEQ ID NO: 1986 - protein, 17 aa, Mus sp.
GPVPEFSGATVERVSED

SEQ ID NO: 1987 - protein, 19 aa, Mus sp.
VTEDNVFEAPTLVKVFKQP

SEQ ID NO: 1988 - protein, 19 aa, Mus sp.
DYLNSDGSAKSSCVSKDVP

SEQ ID NO: 1989 - protein, 15 aa, Mus sp.
FVAWATGEPNFANDD

SEQ ID NO: 1990 - protein, 16 aa, Mus sp.
GGDPFAAPQVVPAFAS

SEQ ID NO: 1991 - protein, 18 aa, Mus sp.
SIASFKDPKISTSLPVLD

SEQ ID NO: 1992 - protein, 16 aa, Mus sp.
IGRTWNDPSVQQDIKF

SEQ ID NO: 1993 - protein, 17 aa, Mus sp.
GRFTYQNAAAQPETGPG

SEQ ID NO: 1994 - protein, 15 aa, Mus sp.
LEDFYGSPIPSVSLK

SEQ ID NO: 1995 - protein, 15 aa, Mus sp.
SVAFIKPGVNKAEVT

SEQ ID NO: 1996 - protein, 22 aa, Mus sp.
TPARAPETRSQVTPSVPSEALD

SEQ ID NO: 1997 - protein, 17 aa, Mus sp.
GEFDYSGSQAIKALKEE

SEQ ID NO: 1998 - protein, 15 aa, Mus sp.
LSYREPDPEDAVGGS

SEQ ID NO: 1999 - protein, 14 aa, Mus sp.
KSKYKASIAALEAK

SEQ ID NO: 2000 - protein, 21 aa, Mus sp.
GPPRLDLLDLAPEPRYAHIPV

SEQ ID NO: 2001 - protein, 14 aa, Mus sp.
TNDRYVASLAARNK

SEQ ID NO: 2002 - protein, 14 aa, Mus sp.
QKAMFDHLSYLLEN

SEQ ID NO: 2003 - protein, 16 aa, Mus sp.
DIDSFVPSKAAPAAAA

SEQ ID NO: 2004 - protein, 16 aa, Mus sp.
LPETFRRPQIDPAVEG

SEQ ID NO: 2005 - protein, 16 aa, Mus sp.
IFNKFKFPAAVVVEDD

SEQ ID NO: 2006 - protein, 18 aa, Mus sp.
NSNSYGIPEPAHAYAQPQ

SEQ ID NO: 2007 - protein, 14 aa, Mus sp.
VNGKKFTAPHILIA

SEQ ID NO: 2008 - protein, 16 aa, Mus sp.
KFDEWVAPTPEVADMQ

SEQ ID NO: 2009 - protein, 14 aa, Mus sp.
ADKEFHAPLIIDEN

SEQ ID NO: 2010 - protein, 16 aa, Mus sp.
EMNLMHAPQVADAILG

SEQ ID NO: 2011 - protein, 20 aa, Mus sp.
QPTGPPPYHESLAGASQPPY

SEQ ID NO: 2012 - protein, 15 aa, Mus sp.
ANPDFTQPISEVVDE

SEQ ID NO: 2013 - protein, 17 aa, Mus sp.
DEDIILKAPIAAPEPEL

SEQ ID NO: 2014 - protein, 16 aa, Listeria monocytogenes
EVEDLNQPLAAHVNYE

SEQ ID NO: 2015 - protein, 16 aa, Mus sp.
TEDNVFEAPTLVKVFK

SEQ ID NO: 2016 - protein, 16 aa, Mus sp.
WHIQADHAYQALPSFQ

SEQ ID NO: 2017 - protein, 16 aa, Mus sp.
GPNFEYAEAPSRLSPD

SEQ ID NO: 2018 - protein, 20 aa, Mus sp.
LVTEDNVFEAPTLVKVFKQP

SEQ ID NO: 2019 - protein, 20 aa, Mus sp.
SPTSPNYTPTSPNYSPTSPS

SEQ ID NO: 2020 - protein, 12 aa, Mus sp.
DPYDQPNAIYIE

SEQ ID NO: 2021 - protein, 16 aa, Mus sp.
GAQEMVSSSVSSAKET

SEQ ID NO: 2022 - protein, 14 aa, Mus sp.
VVIEVFTPVVQRIL

SEQ ID NO: 2023 - protein, 13 aa, Mus sp.
RDYVPPTANLDQK

SEQ ID NO: 2024 - protein, 15 aa, Mus sp.
IEGYVPSQADVAVFE

SEQ ID NO: 2025 - protein, 14 aa, Mus sp.
GDIFIGPKAEEHRG

SEQ ID NO: 2026 - protein, 12 aa, Mus sp.
GKKFTAPHILIA

SEQ ID NO: 2027 - protein, 15 aa, Mus sp.
EDNVFEAPTLVKVFK

SEQ ID NO: 2028 - protein, 20 aa, Mus sp.
VPPTPQPVAPTPSAAPAGPK

SEQ ID NO: 2029 - protein, 14 aa, Mus sp.
ECGENFSRISHLVQ

SEQ ID NO: 2030 - protein, 16 aa, Mus sp.
KEFEFIESQTSSHRIN

SEQ ID NO: 2031 - protein, 16 aa, Mus sp.
DGQSVQWWHPQGIIGL

SEQ ID NO: 2032 - protein, 15 aa, Mus sp.
APPLPIKTPIPTPST

SEQ ID NO: 2033 - protein, 17 aa, Mus sp.
NPKAEVARAQAALAVNI

SEQ ID NO: 2034 - protein, 16 aa, Mus sp.
DAGNAFKKADPQEAIN

SEQ ID NO: 2035 - protein, 13 aa, Mus sp.
GEFDYSGSQAIKA

SEQ ID NO: 2036 - protein, 18 aa, Mus sp.
DEAQVEFMASHGNEAARA

SEQ ID NO: 2037 - protein, 17 aa, Mus sp.
TVTPWKAPIVWEGTYDT

SEQ ID NO: 2038 - protein, 15 aa, Mus sp.
LALMYNTPRAATIIA

SEQ ID NO: 2039 - protein, 12 aa, Mus sp.
GHKLGLGLEFQA

SEQ ID NO: 2040 - protein, 15 aa, Mus sp.
AKVELVPPTPAEIPT

SEQ ID NO: 2041 - protein, 16 aa, Mus sp.
YLLSQSSPAPLTAAEE

SEQ ID NO: 2042 - protein, 14 aa, Mus sp.
DIFIGPKAEEHRGL

SEQ ID NO: 2043 - protein, 15 aa, Mus sp.
TENGYSYPVVSYWVD

SEQ ID NO: 2044 - protein, 20 aa, Mus sp.
EMEKEDRRYNPPIIHQGFQD

SEQ ID NO: 2045 - protein, 17 aa, Mus sp.
VHLWRYEGGYPALTEVM

SEQ ID NO: 2046 - protein, 18 aa, Mus sp.
GPHSMRYFETAVSRPGLE

SEQ ID NO: 2047 - protein, 15 aa, Mus sp.
RITPSYVAFTPEGER

SEQ ID NO: 2048 - protein, 15 aa, Mus sp.
EVSSVEAPSVSPARH

SEQ ID NO: 2049 - protein, 24 aa, Mus sp.
DSGDGVTHTVPIYEGYALPHAILR

SEQ ID NO: 2050 - protein, 16 aa, Mus sp.
APASAEAPAPNQAPAP

SEQ ID NO: 2051 - protein, 14 aa, Mus sp.
GNSEFDPPGPNVAT

SEQ ID NO: 2052 - protein, 15 aa, Mus sp.
VAVNWYAPLVAPISK

SEQ ID NO: 2053 - protein, 15 aa, Mus sp.
GYDPIISPEVAASFG

SEQ ID NO: 2054 - protein, 22 aa, Mus sp.
EEKYHEALAKGDVTTQVALQPA

SEQ ID NO: 2055 - protein, 15 aa, Mus sp.
FPQYTAPSILPSDIT

SEQ ID NO: 2056 - protein, 15 aa, Mus sp.
ITPSYVAFTPEGERL

SEQ ID NO: 2057 - protein, 14 aa, Mus sp.
VRVSYYGPKTSPVQ

SEQ ID NO: 2058 - protein, 17 aa, Mus sp.
QPYSHSTAPSALPALDS

SEQ ID NO: 2059 - protein, 16 aa, Mus sp.
IARQNFTEPTAIQAQG

SEQ ID NO: 2060 - protein, 18 aa, Mus sp.
GGGDPEAPAPAPAAERPP

SEQ ID NO: 2061 - protein, 13 aa, Mus sp.
YTIPFYTPIPNGL

SEQ ID NO: 2062 - protein, 17 aa, Mus sp.
GPRPEEYEFLTPVEEAP

SEQ ID NO: 2063 - protein, 14 aa, Mus sp.
NIPYFETSAKEAIN

SEQ ID NO: 2064 - protein, 17 aa, Mus sp.
EPSKYYYEVSLPSGLEE

SEQ ID NO: 2065 - protein, 14 aa, Mus sp.
DGYQMAQPVFAPKN

SEQ ID NO: 2066 - protein, 26 aa, Mus sp.
GNPTVEVDLYTAKGLFRAAVPSGAST

SEQ ID NO: 2067 - protein, 20 aa, Mus sp.
YPNPTLDHYKEPSAIFQLPY

SEQ ID NO: 2068 - protein, 17 aa, Mus sp.
APQQAAAPEPTSAFNPR

SEQ ID NO: 2069 - protein, 17 aa, Mus sp.
SDGYPVLYPTGWSSSDN

SEQ ID NO: 2070 - protein, 18 aa, Mus sp.
SLKYHFVTPLTSMVVTKP

SEQ ID NO: 2071 - protein, 15 aa, Mus sp.
KLQMEAPHIIVGTPG

SEQ ID NO: 2072 - protein, 13 aa, Mus sp.
TPEYLAPEIILSK

SEQ ID NO: 2073 - protein, 14 aa, Mus sp.
EEKYHEALAKGDVT

SEQ ID NO: 2074 - protein, 14 aa, Mus sp.
GAFTYYGVSALTAP

SEQ ID NO: 2075 - protein, 14 aa, Mus sp.
ADDTYTESYISTIG

SEQ ID NO: 2076 - protein, 18 aa, Listeria monocytogenes
MNRVMLPLQQMGAKMHGK

SEQ ID NO: 2077 - protein, 18 aa, Mus sp.
GADKTVKGPDGLTALEAT

SEQ ID NO: 2078 - protein, 15 aa, Mus sp.
GSDIFAAPAPQSTAT

SEQ ID NO: 2079 - protein, 20 aa, Mus sp.
SPTSPSYSPTSPSYSPTSPS

SEQ ID NO: 2080 - protein, 33 aa, Mus sp.
EIFDSRGNPTVEVDLYTAKGLFRAAVPSGASTG

SEQ ID NO: 2081 - protein, 19 aa, Listeria monocytogenes
TVRAKSKTYPVYINEFALE

SEQ ID NO: 2082 - protein, 16 aa, Mus sp.
VPIYEGYALPHAILRL

SEQ ID NO: 2083 - protein, 13 aa, Mus sp.
YQMYGGPVVLVAH

SEQ ID NO: 2084 - protein, 17 aa, Mus sp.
LPEAPSAESPSPSESPP

SEQ ID NO: 2085 - protein, 12 aa, Mus sp.
DEGERYIAPTVL

SEQ ID NO: 2086 - protein, 15 aa, Mus sp.
GTPDYIAPEIIAYQP

SEQ ID NO: 2087 - protein, 16 aa, Mus sp.
APLDELVGAYPNYNEE

SEQ ID NO: 2088 - protein, 15 aa, Mus sp.
TSSLAAPTVEAAASA

SEQ ID NO: 2089 - protein, 17 aa, Mus sp.
TSSLAAPTVEAAASAPA

SEQ ID NO: 2090 - protein, 21 aa, Mus sp.
GVEAARDNMFSGSKINYTENR

SEQ ID NO: 2091 - protein, 18 aa, Mus sp.
EETELDQLFSGPLPGRLP

SEQ ID NO: 2092 - protein, 18 aa, Mus sp.
ADGREVSSVEAPSVSPAR

SEQ ID NO: 2093 - protein, 15 aa, Mus sp.
LTTSSYSNPTIGYEN

SEQ ID NO: 2094 - protein, 14 aa, Mus sp.
ALDTFNTSLVTPIY

SEQ ID NO: 2095 - protein, 15 aa, Mus sp.
VQPYSGSPANLAAYT

SEQ ID NO: 2096 - protein, 17 aa, Mus sp.
TTSSYSNPTIGYENRVL

SEQ ID NO: 2097 - protein, 14 aa, Mus sp.
DASFVAAIPSTQVV

SEQ ID NO: 2098 - protein, 14 aa, Mus sp.
ADDIVGPVTHEIFE

SEQ ID NO: 2099 - protein, 17 aa, Mus sp.
GAVIFNFPGTRNEVIPM

SEQ ID NO: 2100 - protein, 17 aa, Mus sp.
DPQLSYAVSWAKVSESG

SEQ ID NO: 2101 - protein, 18 aa, Mus sp.
ERLYLLAAPSAERSDWIQ

SEQ ID NO: 2102 - protein, 13 aa, Mus sp.
DFYGSPIPSVSLK

SEQ ID NO: 2103 - protein, 14 aa, Mus sp.
LAWNAPAVLQKPYN

SEQ ID NO: 2104 - protein, 19 aa, Mus sp.
DPAKGRIYQGTEADSIFSG

SEQ ID NO: 2105 - protein, 18 aa, Mus sp.
DPGVPSEWTSPASAGSSD

SEQ ID NO: 2106 - protein, 17 aa, Mus sp.
GTVIHFNNPKVQASLAA

SEQ ID NO: 2107 - protein, 21 aa, Mus sp.
GSKVDFVAWATGEPNFANDDE

SEQ ID NO: 2108 - protein, 18 aa, Mus sp.
YKKELEEQLGPVAEETRA

SEQ ID NO: 2109 - protein, 15 aa, Mus sp.
DPSAFAAAAPAAAAT

SEQ ID NO: 2110 - protein, 14 aa, Mus sp.
KPTVTVVSPLPNDS

SEQ ID NO: 2111 - protein, 13 aa, Mus sp.
RYMAPEVLDETIN

SEQ ID NO: 2112 - protein, 16 aa, Mus sp.
FPGAQHYVGGNAALIG

SEQ ID NO: 2113 - protein, 23 aa, Mus sp.
YPPPYPPAAFQGPSDHAAYPIPQ

SEQ ID NO: 2114 - protein, 17 aa, Mus sp.
APVEGASPTSISAVDGL

SEQ ID NO: 2115 - protein, 15 aa, Mus sp.
TAQWNICLPLLQHNL

SEQ ID NO: 2116 - protein, 16 aa, Mus sp.
SGLEVVAPEVTSAPVS

SEQ ID NO: 2117 - protein, 14 aa, Mus sp.
IDWTYRPPSSSRTE

SEQ ID NO: 2118 - protein, 15 aa, Mus sp.
AEEYLGMPVANAVIS

SEQ ID NO: 2119 - protein, 22 aa, Mus sp.
RRKGEQIYYAGPVNNPGLDVPQ

SEQ ID NO: 2120 - protein, 19 aa, Mus sp.
DERFGVRFPAMSDAYDRDM

SEQ ID NO: 2121 - protein, 18 aa, Mus sp.
KPSPIYISSYSSPAREQN

SEQ ID NO: 2122 - protein, 13 aa, Mus sp.
MYKVHNPVPLIVG

SEQ ID NO: 2123 - protein, 16 aa, Mus sp.
KQIVWNGPVGVFEWEA

SEQ ID NO: 2124 - protein, 18 aa, Mus sp.
IVLQAAVPKSMKVKLQPP

SEQ ID NO: 2125 - protein, 15 aa, Mus sp.
MYPTGAPGAQAAPQA

SEQ ID NO: 2126 - protein, 15 aa, Mus sp.
RPDAEYWNSQPEILE

SEQ ID NO: 2127 - protein, 15 aa, Mus sp.
LLYNVPAVAEEIQDE

SEQ ID NO: 2128 - protein, 13 aa, Mus sp.
VGAWTGPMGNWAM

SEQ ID NO: 2129 - protein, 18 aa, Mus sp.
DTIEFRGPNGLLVYQGKG

SEQ ID NO: 2130 - protein, 15 aa, Mus sp.
DIDSFVPSKAAPAAA

SEQ ID NO: 2131 - protein, 15 aa, Mus sp.
EEVEHWFYPQENIID

SEQ ID NO: 2132 - protein, 14 aa, Mus sp.
DQKFYNFVVIHARA

SEQ ID NO: 2133 - protein, 16 aa, Mus sp.
AKQIVWNGPVGVFEWE

SEQ ID NO: 2134 - protein, 17 aa, Mus sp.
SGALLLNAPVVSITQGR

SEQ ID NO: 2135 - protein, 15 aa, Mus sp.
NPEAMVAPSVLSNIQ

SEQ ID NO: 2136 - protein, 14 aa, Mus sp.
EEIEVAPPKAHEVR

SEQ ID NO: 2137 - protein, 14 aa, Mus sp.
WSDAAAPFAGLSTD

SEQ ID NO: 2138 - protein, 15 aa, Mus sp.
DFVAWATGEPNFAND

SEQ ID NO: 2139 - protein, 17 aa, Mus sp.
DGELTYENVQVSPVPGG

SEQ ID NO: 2140 - protein, 14 aa, Mus sp.
GYKPFQNPVPNQSP

SEQ ID NO: 2141 - protein, 14 aa, Mus sp.
SMIVNVSCTSACTD

SEQ ID NO: 2142 - protein, 16 aa, Mus sp.
QPVVIYSSPGVILPKQ

SEQ ID NO: 2143 - protein, 19 aa, Mus sp.
FPKPPSYNVATTLPSYDEA

SEQ ID NO: 2144 - protein, 18 aa, Mus sp.
LPQLRNVGGVRAIPYMQV

SEQ ID NO: 2145 - protein, 18 aa, Mus sp.
WDLVDAVTPSPQPSKEED

SEQ ID NO: 2146 - protein, 16 aa, Mus sp.
LSLDWHPNNVLLAAGS

SEQ ID NO: 2147 - protein, 17 aa, Mus sp.
EPIKSFEAPATINSASL

SEQ ID NO: 2148 - protein, 13 aa, Mus sp.
VNWYAPLVAPISK

SEQ ID NO: 2149 - protein, 16 aa, Mus sp.
GGLPDYSAPNPIKVTH

SEQ ID NO: 2150 - protein, 18 aa, Mus sp.
DPKLTYHGFTLEDAASPK

SEQ ID NO: 2151 - protein, 15 aa, Mus sp.
LHLRFSAPQIENEPE

SEQ ID NO: 2152 - protein, 14 aa, Mus sp.
GEFDYSGSQAIKAL

SEQ ID NO: 2153 - protein, 18 aa, Mus sp.
RQPAWRDPLSPFAVGGDD

SEQ ID NO: 2154 - protein, 15 aa, Mus sp.
IPPTHYAASRAASVA

SEQ ID NO: 2155 - protein, 16 aa, Mus sp.
TRPHWLEPTIYSSEED

SEQ ID NO: 2156 - protein, 17 aa, Mus sp.
DRKIVYEGPELNHAFGL

SEQ ID NO: 2157 - protein, 17 aa, Mus sp.
IPETYPFNPPKVRFITK

SEQ ID NO: 2158 - protein, 17 aa, Mus sp.
AKPSGYNPPISILGILE

SEQ ID NO: 2159 - protein, 16 aa, Mus sp.
ITGVDFIGSTVGLAKV

SEQ ID NO: 2160 - protein, 14 aa, Mus sp.
LVQTYVGAISNGSL

SEQ ID NO: 2161 - protein, 11 aa, Mus sp.
TPDYIAPEILQ

SEQ ID NO: 2162 - protein, 19 aa, Mus sp.
SPSSPEYTPASPKYSPTSP

SEQ ID NO: 2163 - protein, 15 aa, Mus sp.
GSTLWSSPLPEEAQD

SEQ ID NO: 2164 - protein, 11 aa, Mus sp.
TIPFYTPIPNG

SEQ ID NO: 2165 - protein, 18 aa, Mus sp.
EDPDGFSWPATLPSVYKQ

SEQ ID NO: 2166 - protein, 12 aa, Mus sp.
TPEYLAPEIILS

SEQ ID NO: 2167 - protein, 18 aa, Mus sp.
ITIGNERFRCPEAIFQPS

SEQ ID NO: 2168 - protein, 16 aa, Mus sp.
TKKFRFEEPVVLPDLS

SEQ ID NO: 2169 - protein, 17 aa, Mus sp.
KDIDSFVPSKAAPAAAA

SEQ ID NO: 2170 - protein, 22 aa, Mus sp.
GSKVDFVAWATGEPNFANDDEN

SEQ ID NO: 2171 - protein, 15 aa, Mus sp.
VYTRYHCSLPVPEPS

SEQ ID NO: 2172 - protein, 18 aa, Mus sp.
KFGNSEFDPPGPNVATTT

SEQ ID NO: 2173 - protein, 12 aa, Mus sp.
VAFNGPKGGYVA

SEQ ID NO: 2174 - protein, 10 aa, Mus sp.
FGIHNGVETL

SEQ ID NO: 2175 - protein, 14 aa, Mus sp.
EELVITPLPSGDVA

SEQ ID NO: 2176 - protein, 14 aa, Mus sp.
ITWTWQGPGALKIL

SEQ ID NO: 2177 - protein, 16 aa, Mus sp.
EYFVFRPGTIEQAVEE

SEQ ID NO: 2178 - protein, 15 aa, Mus sp.
KNLDYVATSIHEAVT

SEQ ID NO: 2179 - protein, 23 aa, Mus sp.
VPDGPEAPLDELVGAYPNYNEEE

SEQ ID NO: 2180 - protein, 15 aa, Mus sp.
NLDWQYPGSRGSPPK

SEQ ID NO: 2181 - protein, 14 aa, Mus sp.
VKDGYQMAQPVFAP

SEQ ID NO: 2182 - protein, 20 aa, Mus sp.
TPSPESPDQWSSSSPHSASD

SEQ ID NO: 2183 - protein, 15 aa, Mus sp.
ELDQLFSGPLPGRLP

SEQ ID NO: 2184 - protein, 15 aa, Mus sp.
ISNYGFPRSVQAIDA

SEQ ID NO: 2185 - protein, 14 aa, Mus sp.
DGFSWPATLPSVYK

SEQ ID NO: 2186 - protein, 15 aa, Mus sp.
DSYRSPWSNKYDPPL

SEQ ID NO: 2187 - protein, 17 aa, Mus sp.
NPTDAYLDAMMNEAPGP

SEQ ID NO: 2188 - protein, 15 aa, Mus sp.
DLKWGTPVPLEGFED

SEQ ID NO: 2189 - protein, 19 aa, Mus sp.
APLNVQFSSPLPGEAVKDL

SEQ ID NO: 2190 - protein, 13 aa, Mus sp.
ASFKDPKISTSLP

SEQ ID NO: 2191 - protein, 16 aa, Mus sp.
GDNLVHAAIVAESAAI

SEQ ID NO: 2192 - protein, 15 aa, Mus sp.
EFDYSGSQAIKALKE

SEQ ID NO: 2193 - protein, 17 aa, Mus sp.
SEDNVYHSSNAVYRAPS

SEQ ID NO: 2194 - protein, 16 aa, Mus sp.
GDSNFGAPSASVAAAP

SEQ ID NO: 2195 - protein, 17 aa, Mus sp.
VDLPNYSSPNALVLNTK

SEQ ID NO: 2196 - protein, 17 aa, Mus sp.
LPFGAYTNPFATPAQAQ

SEQ ID NO: 2197 - protein, 16 aa, Mus sp.
KPSPIYISSYSSPARE

SEQ ID NO: 2198 - protein, 17 aa, Mus sp.
DINAFVGAVSLTAADSN

SEQ ID NO: 2199 - protein, 20 aa, Mus sp.
FYVDLDKKETVWMLPEFGQL

SEQ ID NO: 2200 - protein, 15 aa, Mus sp.
DSPDVVYSPETIEAR

SEQ ID NO: 2201 - protein, 14 aa, Mus sp.
SRGEYSWAVAQGVK

SEQ ID NO: 2202 - protein, 20 aa, Mus sp.
RKGEQIYYAGPVNNPGLDVP

SEQ ID NO: 2203 - protein, 18 aa, Mus sp.
DERFGVRFPAMSDAYDRD

SEQ ID NO: 2204 - protein, 16 aa, Mus sp.
RNYEYYASHVPESVKN

SEQ ID NO: 2205 - protein, 20 aa, Mus sp.
GNPLNSVFVAPAVTPVKGVL

SEQ ID NO: 2206 - protein, 15 aa, Mus sp.
IDPYDQPNAIYIERH

SEQ ID NO: 2207 - protein, 14 aa, Mus sp.
APPHFHFGQTNRTP

SEQ ID NO: 2208 - protein, 13 aa, Mus sp.
NAANVGWNGSTFA

SEQ ID NO: 2209 - protein, 14 aa, Mus sp.
DKDSFSDPYAHVSF

SEQ ID NO: 2210 - protein, 15 aa, Mus sp.
TSSYYRGAHGIIVVY

SEQ ID NO: 2211 - protein, 21 aa, Mus sp.
YPPPYPPAAFQGPSDHAAYPI

SEQ ID NO: 2212 - protein, 13 aa, Mus sp.
IKVYWDAPSPAPD

SEQ ID NO: 2213 - protein, 23 aa, Mus sp.
KPFPWGDGNHTLFHNPHVNPLPT

SEQ ID NO: 2214 - protein, 16 aa, Mus sp.
LSRFTSGVPSFVLDTE

SEQ ID NO: 2215 - protein, 17 aa, Mus sp.
GIDPYDQPNAIYIERHE

SEQ ID NO: 2216 - protein, 15 aa, Mus sp.
VLIPYQGPSSDYVVV

SEQ ID NO: 2217 - protein, 12 aa, Mus sp.
LFHNPHVNPLPT

SEQ ID NO: 2218 - protein, 14 aa, Mus sp.
NPDFTQPISEVVDE

SEQ ID NO: 2219 - protein, 16 aa, Mus sp.
YVELPPSVSQAATSPP

SEQ ID NO: 2220 - protein, 15 aa, Mus sp.
AAPASAPTPSTPAPT

SEQ ID NO: 2221 - protein, 14 aa, Mus sp.
GKWKYEKPDGSPVF

SEQ ID NO: 2222 - protein, 17 aa, Mus sp.
RFGPYYTEPVIAGLDPK

SEQ ID NO: 2223 - protein, 17 aa, Mus sp.
FGKWKYEKPDGSPVFIA

SEQ ID NO: 2224 - protein, 11 aa, Mus sp.
FPYVTPAPHEP

SEQ ID NO: 2225 - protein, 15 aa, Mus sp.
DIRSDWTNPEINKAV

SEQ ID NO: 2226 - protein, 17 aa, Mus sp.
GNNCKNGGACVDGVNTY

SEQ ID NO: 2227 - protein, 17 aa, Mus sp.
DEAQVEFMASHGNEAAR

SEQ ID NO: 2228 - protein, 17 aa, Mus sp.
ARMAPYQGPDAAPGALD

SEQ ID NO: 2229 - protein, 18 aa, Mus sp.
LITGVDFIGSTVGLAKVS

SEQ ID NO: 2230 - protein, 18 aa, Mus sp.
DGTVIHFNNPKVQASLSA

SEQ ID NO: 2231 - protein, 18 aa, Mus sp.
DKDPFWWNGAEPIWVTNQ

SEQ ID NO: 2232 - protein, 17 aa, Mus sp.
VPKHEYTYPYVDSSDFG

SEQ ID NO: 2233 - protein, 15 aa, Mus sp.
ATLEIKGPQADLIDA

SEQ ID NO: 2234 - protein, 20 aa, Mus sp.
DEGERYIAPTVLVDVQETEP

SEQ ID NO: 2235 - protein, 18 aa, Mus sp.
APAAATSAPAPAPAPAPA

SEQ ID NO: 2236 - protein, 15 aa, Mus sp.
AGPQWADPQISESNF

SEQ ID NO: 2237 - protein, 17 aa, Mus sp.
DSKQYYQQPTATAAAVA

SEQ ID NO: 2238 - protein, 16 aa, Mus sp.
SQELVRAPTAALSPEP

SEQ ID NO: 2239 - protein, 17 aa, Mus sp.
RPDAEYWNSQPEILERT

SEQ ID NO: 2240 - protein, 15 aa, Mus sp.
SLLYNVPAVAEEIQD

SEQ ID NO: 2241 - protein, 18 aa, Mus sp.
DSSRLPSEGPQPAHVVVG

SEQ ID NO: 2242 - protein, 14 aa, Mus sp.
IQFNNYQVRYRPEL

SEQ ID NO: 2243 - protein, 16 aa, Mus sp.
NSTDGGSFCHVKASPI

SEQ ID NO: 2244 - protein, 17 aa, Mus sp.
AFALQEQPVVNAVIDDA

SEQ ID NO: 2245 - protein, 17 aa, Mus sp.
NNIPYFETSAKEAINVE

SEQ ID NO: 2246 - protein, 15 aa, Mus sp.
GSVLWERPVAQDVAL

SEQ ID NO: 2247 - protein, 17 aa, BOVIN
SVVVGPSVVAVPLPLHR

SEQ ID NO: 2248 - protein, 16 aa, Mus sp.
AAPASAPTPSTPAPTP

SEQ ID NO: 2249 - protein, 13 aa, Mus sp.
LPVKWMAPESIFD

SEQ ID NO: 2250 - protein, 19 aa, Mus sp.
ETKKFRFEEPVVLPDLSDQ

SEQ ID NO: 2251 - protein, 16 aa, Mus sp.
EGERYIAPTVLVDVQE

SEQ ID NO: 2252 - protein, 15 aa, Mus sp.
STLIWAAPRLQSEVA

SEQ ID NO: 2253 - protein, 16 aa, Mus sp.
HADASFVAAIPSTQVV

SEQ ID NO: 2254 - protein, 13 aa, Mus sp.
KWKYEKPDGSPVF

SEQ ID NO: 2255 - protein, 16 aa, Mus sp.
QIYYAGPVNNPGLDVP

SEQ ID NO: 2256 - protein, 16 aa, Mus sp.
PMFIVNTNVPRASVPE

SEQ ID NO: 2257 - protein, 16 aa, Mus sp.
IEFTFERSNTNPSVTV

SEQ ID NO: 2258 - protein, 22 aa, Mus sp.
GADELLKRVYGSFLVNPEPGYN

SEQ ID NO: 2259 - protein, 16 aa, Mus sp.
IEVDQIYHLASPASPP

SEQ ID NO: 2260 - protein, 16 aa, Mus sp.
TSSLAAPTVEAAASAP

SEQ ID NO: 2261 - protein, 13 aa, Mus sp.
RSNEFDYPSVGQL

SEQ ID NO: 2262 - protein, 15 aa, Mus sp.
EKVIVDFSSPNIAKE

SEQ ID NO: 2263 - protein, 23 aa, Mus sp.
APTPSTPAPTPAATPAASPAPVS

SEQ ID NO: 2264 - protein, 18 aa, Mus sp.
DGIHHWTPPKGHVDPGEN

SEQ ID NO: 2265 - protein, 17 aa, Mus sp.
GDTHFDSAEPWTVQNED

SEQ ID NO: 2266 - protein, 17 aa, Mus sp.
EGEMTLKSALALAVKVL

SEQ ID NO: 2267 - protein, 16 aa, Mus sp.
RDNMFSGSKINYTENR

SEQ ID NO: 2268 - protein, 17 aa, Mus sp.
NPDYKGTWIHPEIDNPE

SEQ ID NO: 2269 - protein, 18 aa, Mus sp.
MRTSVDQNVYPSQNGTPN

SEQ ID NO: 2270 - protein, 16 aa, Mus sp.
EGDIFIGPKAEEHRGL

SEQ ID NO: 2271 - protein, 13 aa, Mus sp.
IRSDWTNPEINKA

SEQ ID NO: 2272 - protein, 17 aa, Mus sp.
AQRAGYKAAIVHNVDSD

SEQ ID NO: 2273 - protein, 15 aa, Mus sp.
NVTELNEPLSNEERN

SEQ ID NO: 2274 - protein, 27 aa, Mus sp.
GGLDSLIGDSNFGAPSASVAAAPAPAR

SEQ ID NO: 2275 - protein, 16 aa, Mus sp.
FTAQWIAPSVQLTGYR

SEQ ID NO: 2276 - protein, 17 aa, Mus sp.
LPQDPTFHTPLDLYAYA

SEQ ID NO: 2277 - protein, 16 aa, Mus sp.
NPTDEYLDAMMNEAPG

SEQ ID NO: 2278 - protein, 13 aa, Mus sp.
APGGYVAPKAVWL

SEQ ID NO: 2279 - protein, 16 aa, Mus sp.
GDSYRSPWSNKYDPPL

SEQ ID NO: 2280 - protein, 13 aa, Mus sp.
LPSTWSDPSVNIS

SEQ ID NO: 2281 - protein, 16 aa, Mus sp.
KVNAVFSPKAASSPED

SEQ ID NO: 2282 - protein, 14 aa, Mus sp.
EPPPAYEPPAPAPA

SEQ ID NO: 2283 - protein, 12 aa, Mus sp.
EDFYGSPIPSVS

SEQ ID NO: 2284 - protein, 14 aa, Mus sp.
APMYYRGAQAAIVV

SEQ ID NO: 2285 - protein, 18 aa, Mus sp.
RTDWEAPTGQPSAPGPRP

SEQ ID NO: 2286 - protein, 14 aa, Mus sp.
FDQGYEAPGVREAA

SEQ ID NO: 2287 - protein, 16 aa, Mus sp.
TPPPAAAPIPAPSTEE

SEQ ID NO: 2288 - protein, 15 aa, Mus sp.
TPDYIAPEILQGLKY

SEQ ID NO: 2289 - protein, 21 aa, Mus sp.
EGDTYEYRVSAVNIVGQGKPS

SEQ ID NO: 2290 - protein, 16 aa, Mus sp.
YPNSFSAPEQQRSALE

SEQ ID NO: 2291 - protein, 15 aa, Mus sp.
TARYMAPEVLESRMN

SEQ ID NO: 2292 - protein, 17 aa, Mus sp.
VHKSFVEVNEEGTEAAA

SEQ ID NO: 2293 - protein, 21 aa, Mus sp.
DPTPDPNTAYASYPSASVENY

SEQ ID NO: 2294 - protein, 18 aa, Mus sp.
EDYVELPPSVSQAATSPP

SEQ ID NO: 2295 - protein, 14 aa, Mus sp.
GYTYTASAIKHVIT

SEQ ID NO: 2296 - protein, 15 aa, Mus sp.
MDEAYVQPEPLGVVL

SEQ ID NO: 2297 - protein, 19 aa, Mus sp.
DAFKHAVSDPSILDSLDLN

SEQ ID NO: 2298 - protein, 18 aa, Mus sp.
DTSSKVIQSVANYAKGDL

SEQ ID NO: 2299 - protein, 15 aa, Mus sp.
GMAFRVPTPNVSVVD

SEQ ID NO: 2300 - protein, 16 aa, Mus sp.
APLPPWKTPSSSQPPP

SEQ ID NO: 2301 - protein, 14 aa, Mus sp.
VEPYEVHNPVPLIV

SEQ ID NO: 2302 - protein, 16 aa, Mus sp.
RPEEVEAEAVNRSITI

SEQ ID NO: 2303 - protein, 17 aa, Mus sp.
RITPSYVAFTPEGERLI

SEQ ID NO: 2304 - protein, 15 aa, Mus sp.
APTSALGPKASPAPS

SEQ ID NO: 2305 - protein, 14 aa, Mus sp.
VQTYVGAISNGSLP

SEQ ID NO: 2306 - protein, 15 aa, Mus sp.
LRIINEPTAAAIAYG

SEQ ID NO: 2307 - protein, 18 aa, Mus sp.
GKKFTAPHILIATGGVPT

SEQ ID NO: 2308 - protein, 16 aa, Mus sp.
LRYNITHPVVNDADAS

SEQ ID NO: 2309 - protein, 14 aa, Mus sp.
GDLEYQMSTTARAK

SEQ ID NO: 2310 - protein, 15 aa, Mus sp.
YPFDFQGAKIITGQE

SEQ ID NO: 2311 - protein, 18 aa, Mus sp.
DPDGFSWPATLPSVYKQP

SEQ ID NO: 2312 - protein, 19 aa, Mus sp.
VDGDVVHGFYNPAVSRIVE

SEQ ID NO: 2313 - protein, 15 aa, Mus sp.
STDYGNFLANEASPL

SEQ ID NO: 2314 - protein, 15 aa, Mus sp.
APFDWEGAQASQALL

SEQ ID NO: 2315 - protein, 14 aa, Mus sp.
AYNFDETKDLDLDD

SEQ ID NO: 2316 - protein, 20 aa, Mus sp.
IDNSKEFEFIESQTSSHRIN

SEQ ID NO: 2317 - protein, 16 aa, Mus sp.
DFDEEYFSSTSELAKD

SEQ ID NO: 2318 - protein, 18 aa, Mus sp.
MKNVTELNEPLSNEERNL

SEQ ID NO: 2319 - protein, 15 aa, Mus sp.
LDNYLTSPLPEEVDE

SEQ ID NO: 2320 - protein, 14 aa, Mus sp.
NSVFVAPAVTPVKG

SEQ ID NO: 2321 - protein, 19 aa, Mus sp.
TETKVEPYEVHNPVPLIVG

SEQ ID NO: 2322 - protein, 18 aa, Mus sp.
VLRYNITHPVVNDADASL

SEQ ID NO: 2323 - protein, 25 aa, Mus sp.
GPSAPATPAAEAKAAEAAASAYYNP

SEQ ID NO: 2324 - protein, 17 aa, Mus sp.
KVLPTYDASKVTASGPG

SEQ ID NO: 2325 - protein, 17 aa, Mus sp.
VEYHFLSPYVSPRESPF

SEQ ID NO: 2326 - protein, 17 aa, Mus sp.
DEQEFVYKEPAITKLPE

SEQ ID NO: 2327 - protein, 21 aa, Mus sp.
DVVDRVLKSPVASIVYELNPN

SEQ ID NO: 2328 - protein, 16 aa, Mus sp.
TPAPTPAATPAASPAP

SEQ ID NO: 2329 - protein, 15 aa, Mus sp.
LGTEEISPRVLQSLG

SEQ ID NO: 2330 - protein, 19 aa, BOVIN
GPPVASVVVGPSVVAVPLP

SEQ ID NO: 2331 - protein, 17 aa, Mus sp.
FPTLKFFPASADRTVID

SEQ ID NO: 2332 - protein, 11 aa, Mus sp.
AWTGPMGNWAM

SEQ ID NO: 2333 - protein, 17 aa, Mus sp.
DYVELPPSVSQAATSPP

SEQ ID NO: 2334 - protein, 14 aa, Mus sp.
FRVPTPNVSVVDLT

SEQ ID NO: 2335 - protein, 15 aa, Mus sp.
TMLSGKDTVQHWNWT

SEQ ID NO: 2336 - protein, 8 aa, Mus sp.
FNLVYENL

SEQ ID NO: 2337 - protein, 26 aa, Mus sp.
ITGLDPAGPNFEYAEAPSRLSPDDAD

SEQ ID NO: 2338 - protein, 13 aa, Mus sp.
EWKDYKAGFGNLE

SEQ ID NO: 2339 - protein, 13 aa, Mus sp.
VKDGYQMAQPVFA

SEQ ID NO: 2340 - protein, 16 aa, Mus sp.
IRSDWTNPEINKAVLH

SEQ ID NO: 2341 - protein, 19 aa, Mus sp.
KKFGNSEFDPPGPNVATTT

SEQ ID NO: 2342 - protein, 16 aa, Mus sp.
SFFWNVAPGAESAVAS

SEQ ID NO: 2343 - protein, 16 aa, Mus sp.
IPETYPFNPPKVRFIT

SEQ ID NO: 2344 - protein, 16 aa, Mus sp.
YPFDFQGAKIITGQEE

SEQ ID NO: 2345 - protein, 13 aa, Mus sp.
GTSYQSPHGIPID

SEQ ID NO: 2346 - protein, 12 aa, Mus sp.
TDYNSPEAGNIF

SEQ ID NO: 2347 - protein, 16 aa, Mus sp.
YIEGYVPSQADVAVFE

SEQ ID NO: 2348 - protein, 11 aa, Mus sp.
LPYKSPGINVD

SEQ ID NO: 2349 - protein, 12 aa, Mus sp.
IAWESPQGQVSR

SEQ ID NO: 2350 - protein, 17 aa, Mus sp.
GHPGIIPPHATLVFDVE

SEQ ID NO: 2351 - protein, 20 aa, Mus sp.
KNKPEDYQGGRTGEAIVDAA

SEQ ID NO: 2352 - protein, 23 aa, Mus sp.
GPPGFEDYVELPPSVSQAATSPP

SEQ ID NO: 2353 - protein, 17 aa, Mus sp.
AEIEYAMAYSKAAFERE

SEQ ID NO: 2354 - protein, 14 aa, Mus sp.
ASFKDPKISTSLPV

SEQ ID NO: 2355 - protein, 15 aa, Mus sp.
KGPAFVNPLIPENKE

SEQ ID NO: 2356 - protein, 15 aa, Mus sp.
RPVQFPYVTPAPHEP

SEQ ID NO: 2357 - protein, 20 aa, Mus sp.
KIQASVATNPIITPVAQENQ

SEQ ID NO: 2358 - protein, 15 aa, Mus sp.
NPPSYYTQPVPVPNA

SEQ ID NO: 2359 - protein, 16 aa, Mus sp.
LKRSYSSPDITQALQE

SEQ ID NO: 2360 - protein, 16 aa, Mus sp.
YAKVELVPPTPAEIPT

SEQ ID NO: 2361 - protein, 15 aa, Mus sp.
SKEFEFIESQTSSHR

SEQ ID NO: 2362 - protein, 18 aa, Mus sp.
RPVQFPYVTPAPHEPVKT

SEQ ID NO: 2363 - protein, 15 aa, Mus sp.
ADKTVKGPDGLTALE

SEQ ID NO: 2364 - protein, 17 aa, Mus sp.
GPRAEEYEFLTPMEEAP

SEQ ID NO: 2365 - protein, 18 aa, Mus sp.
DTDRQVWSGSKAAGAPPK

SEQ ID NO: 2366 - protein, 14 aa, Mus sp.
RKIVYEGPELNHAF

SEQ ID NO: 2367 - protein, 15 aa, Mus sp.
EQEVLAPQVVLSLGG

SEQ ID NO: 2368 - protein, 11 aa, Mus sp.
LPYDTPVPGYM

SEQ ID NO: 2369 - protein, 19 aa, Mus sp.
APQGSLGEYLFERLTLKHD

SEQ ID NO: 2370 - protein, 15 aa, Mus sp.
ASLEDFYGSPIPSVS

SEQ ID NO: 2371 - protein, 18 aa, Mus sp.
NPLNSVFVAPAVTPVKGV

SEQ ID NO: 2372 - protein, 15 aa, Mus sp.
KKWVNTPFTASSIEL

SEQ ID NO: 2373 - protein, 18 aa, Mus sp.
KPDSLMGAPSAMVSFYPD

SEQ ID NO: 2374 - protein, 18 aa, Mus sp.
GNPLNSVFVAPAVTPVKG

SEQ ID NO: 2375 - protein, 14 aa, Mus sp.
SDVIHAPLPSPVDK

SEQ ID NO: 2376 - protein, 15 aa, Mus sp.
IGDSNFGAPSASVAA

SEQ ID NO: 2377 - protein, 14 aa, Mus sp.
IDPYDQPNAIYIER

SEQ ID NO: 2378 - protein, 13 aa, Mus sp.
YLVYQEPIPTAQL

SEQ ID NO: 2379 - protein, 16 aa, Mus sp.
VLEMYKVHNPVPLIVG

SEQ ID NO: 2380 - protein, 16 aa, Mus sp.
VRVDEYDYSKPIQGQQ

SEQ ID NO: 2381 - protein, 17 aa, Mus sp.
GSTLWSSPLPEEAQDVT

SEQ ID NO: 2382 - protein, 22 aa, Mus sp.
EQLPNVQVEGPTPNRPRKQLPS

SEQ ID NO: 2383 - protein, 12 aa, Mus sp.
TPDYIAPEILQG

SEQ ID NO: 2384 - protein, 14 aa, Mus sp.
YLNEYGAPDAGGLE

SEQ ID NO: 2385 - protein, 13 aa, Mus sp.
YEWAPPVQNQALA

SEQ ID NO: 2386 - protein, 14 aa, Mus sp.
KDLYYAAPLSIWWQ

SEQ ID NO: 2387 - protein, 14 aa, Mus sp.
YKPFQNPVPNQSPS

SEQ ID NO: 2388 - protein, 18 aa, Mus sp.
EAIETIVAAMSNLVPPVE

SEQ ID NO: 2389 - protein, 12 aa, Mus sp.
DYVATSIHEAVT

SEQ ID NO: 2390 - protein, 20 aa, Mus sp.
FEDYVELPPSVSQAAKSPPG

SEQ ID NO: 2391 - protein, 18 aa, Mus sp.
APLNVQFSSPLPGEAVKD

SEQ ID NO: 2392 - protein, 12 aa, Mus sp.
YYRGAQAAIVVY

SEQ ID NO: 2393 - protein, 16 aa, Mus sp.
GQDHVDFSQPEPHTVL

SEQ ID NO: 2394 - protein, 17 aa, Mus sp.
EEVNIKTAEAQLAYELQ

SEQ ID NO: 2395 - protein, 11 aa, Mus sp.
RVPTPNVSVVD

SEQ ID NO: 2396 - protein, 17 aa, Mus sp.
GEVKAFFESHPAPSAER

SEQ ID NO: 2397 - protein, 17 aa, Mus sp.
AGEEDWTISPVPQSIVD

SEQ ID NO: 2398 - protein, 18 aa, Mus sp.
LVTEDNVFEAPTLVKVFK

SEQ ID NO: 2399 - protein, 13 aa, Mus sp.
NPSYNYEIVNRAS

SEQ ID NO: 2400 - protein, 17 aa, Mus sp.
FVLPANAFASPLQNPDN

SEQ ID NO: 2401 - protein, 15 aa, Mus sp.
DGDSYRSPWSNKYDP

SEQ ID NO: 2402 - protein, 19 aa, Mus sp.
AGPNFEYAEAPSRLSPDDA

SEQ ID NO: 2403 - protein, 18 aa, Mus sp.
VPDVQFKTPQISMSDIDL

SEQ ID NO: 2404 - protein, 18 aa, Mus sp.
VPVPEFADSDPANIVHDF

SEQ ID NO: 2405 - protein, 18 aa, Mus sp.
ITSSYYRGAHGIIVVYDV

SEQ ID NO: 2406 - protein, 15 aa, Mus sp.
LTLMMPYYKLHPESP

SEQ ID NO: 2407 - protein, 16 aa, Mus sp.
FPIKWTAPEAALYGRF

SEQ ID NO: 2408 - protein, 16 aa, Mus sp.
IPKVVKSPSSLPAKPL

SEQ ID NO: 2409 - protein, 15 aa, Mus sp.
LEVVTDPTTNAGYVK

SEQ ID NO: 2410 - protein, 15 aa, Mus sp.
GNVYIHPTAKVAPSA

SEQ ID NO: 2411 - protein, 14 aa, Mus sp.
GQVYAFPSSQSVTE

SEQ ID NO: 2412 - protein, 14 aa, Mus sp.
AWVAFPLALVSGTV

SEQ ID NO: 2413 - protein, 17 aa, Mus sp.
REQFSYVLPTVHSLEPS

SEQ ID NO: 2414 - protein, 13 aa, Mus sp.
GDIFIGPKAEEHR

SEQ ID NO: 2415 - protein, 15 aa, Mus sp.
GNHTLFHNPHVNPLP

SEQ ID NO: 2416 - protein, 15 aa, Mus sp.
YENVQVSPVPGGPPG

SEQ ID NO: 2417 - protein, 17 aa, Mus sp.
VLVFDVTAPNTFKTLDS

SEQ ID NO: 2418 - protein, 18 aa, Mus sp.
GDSNFGAPSASVAAAPAP

SEQ ID NO: 2419 - protein, 18 aa, Mus sp.
YPYPTDFLGPLPANPVKV

SEQ ID NO: 2420 - protein, 17 aa, Mus sp.
DIDTAAKFIGAGAATVG

SEQ ID NO: 2421 - protein, 14 aa, Mus sp.
TPDYIAPEILQGLK

SEQ ID NO: 2422 - protein, 27 aa, Mus sp.
DEPQGWDLVDAVTPSPQPSKEEDGPPA

SEQ ID NO: 2423 - protein, 24 aa, Mus sp.
GDEDLETKKFRFEEPVVLPDLSDQ

SEQ ID NO: 2424 - protein, 14 aa, Mus sp.
LPDYTSPVVLPYSR

SEQ ID NO: 2425 - protein, 16 aa, Mus sp.
DDDFEPYLSPQARPNN

SEQ ID NO: 2426 - protein, 15 aa, Mus sp.
STPSYSIPEASFQDS

SEQ ID NO: 2427 - protein, 14 aa, Mus sp.
YYRYMNPAIVAPDA

SEQ ID NO: 2428 - protein, 15 aa, Mus sp.
RPEEVEAEAVNRSIT

SEQ ID NO: 2429 - protein, 18 aa, Mus sp.
EVERRLTSPVINTSLDTK

SEQ ID NO: 2430 - protein, 14 aa, Mus sp.
GTPEYLAPEIILSK

SEQ ID NO: 2431 - protein, 17 aa, Mus sp.
SPYAFNGGTVLAIAGED

SEQ ID NO: 2432 - protein, 22 aa, Mus sp.
QPVRKNKMASNIFGTPEENPPS

SEQ ID NO: 2433 - protein, 14 aa, Mus sp.
IEFRGPNGLLVYQG

SEQ ID NO: 2434 - protein, 14 aa, Mus sp.
EAGQSKGFGLICFF

SEQ ID NO: 2435 - protein, 16 aa, Mus sp.
DDNVFVPPESLQEEDE

SEQ ID NO: 2436 - protein, 16 aa, Mus sp.
EVLDYSTPTTNGTPEA

SEQ ID NO: 2437 - protein, 13 aa, Mus sp.
LPYDTPVPGYMNN

SEQ ID NO: 2438 - protein, 15 aa, Mus sp.
AEEVYRNSMPASSFQ

SEQ ID NO: 2439 - protein, 18 aa, Mus sp.
DYVELPPSVSQAATSPPG

SEQ ID NO: 2440 - protein, 11 aa, Mus sp.
LSYIGPSVNKA

SEQ ID NO: 2441 - protein, 16 aa, Mus sp.
GKITTDYNSPEAGNIF

SEQ ID NO: 2442 - protein, 18 aa, Mus sp.
ARDNMFSGSKINYTENRA

SEQ ID NO: 2443 - protein, 17 aa, Mus sp.
RPPADFTQPAAAAAAAA

SEQ ID NO: 2444 - protein, 14 aa, Mus sp.
HPIQWNAPEPSHIT

SEQ ID NO: 2445 - protein, 26 aa, Mus sp.
GGLDSLIGDSNFGAPSASVAAAPAPA

SEQ ID NO: 2446 - protein, 13 aa, Mus sp.
IVKYELPLVIKAL

SEQ ID NO: 2447 - protein, 16 aa, Mus sp.
TKGNPARWRDFHSATM

SEQ ID NO: 2448 - protein, 15 aa, Mus sp.
LTPWLAPIVSEGTFD

SEQ ID NO: 2449 - protein, 15 aa, Mus sp.
EGPRYLSSTAVVVAE

SEQ ID NO: 2450 - protein, 17 aa, Mus sp.
IILENYAYPGVLLIGTD

SEQ ID NO: 2451 - protein, 17 aa, Mus sp.
GQDHVDFSQPEPHTVLF

SEQ ID NO: 2452 - protein, 16 aa, Mus sp.
VPSGLFIPSMAIGAIA

SEQ ID NO: 2453 - protein, 14 aa, Mus sp.
LPYDTPVPGYMNNT

SEQ ID NO: 2454 - protein, 14 aa, Mus sp.
RGTSYQSPHGIPID

SEQ ID NO: 2455 - protein, 16 aa, Mus sp.
DPWTAWNAPKPGNWDS

SEQ ID NO: 2456 - protein, 18 aa, BOVIN
PPVASVVVGPSVVAVPLP

SEQ ID NO: 2457 - protein, 17 aa, Mus sp.
VEPYEVHNPVPLIVGSS

SEQ ID NO: 2458 - protein, 16 aa, Mus sp.
EGPEASTPMPSPSPSP

SEQ ID NO: 2459 - protein, 14 aa, Mus sp.
REVSSVEAPSVSPA

SEQ ID NO: 2460 - protein, 16 aa, Mus sp.
YPENWRAFKALIAAQY

SEQ ID NO: 2461 - protein, 16 aa, Mus sp.
DPYDQPNAIYIERHEP

SEQ ID NO: 2462 - protein, 18 aa, Mus sp.
FPGAQHYVGGNAALIGQR

SEQ ID NO: 2463 - protein, 30 aa, Mus sp.
DLDENLPNKPTVTVVSPLPNDSINPQPSPD

SEQ ID NO: 2464 - protein, 16 aa, Mus sp.
DSPDVVYSPETIEARY

SEQ ID NO: 2465 - protein, 14 aa, Mus sp.
ETFHASQPSLTVDG

SEQ ID NO: 2466 - protein, 20 aa, Mus sp.
KPVPAAPVPSPVAPAPVPSR

SEQ ID NO: 2467 - protein, 16 aa, Mus sp.
AINDYKGAVIVVSHDA

SEQ ID NO: 2468 - protein, 18 aa, Mus sp.
SPPPYAAYATPTPEVYGY

SEQ ID NO: 2469 - protein, 17 aa, Mus sp.
SPTVHFTPAEISRSVFE

SEQ ID NO: 2470 - protein, 18 aa, Mus sp.
GRIEHLYKNPQAHIEGNM

SEQ ID NO: 2471 - protein, 11 aa, Mus sp.
ELDYYDSPSVN

SEQ ID NO: 2472 - protein, 13 aa, Mus sp.
NNPWVTPIADQFQ

SEQ ID NO: 2473 - protein, 15 aa, Mus sp.
ADASFVAAIPSTQVV

SEQ ID NO: 2474 - protein, 17 aa, Mus sp.
LTPWLAPIVSEGTFDPE

SEQ ID NO: 2475 - protein, 15 aa, Mus sp.
ETETVFAPVIQAGME

SEQ ID NO: 2476 - protein, 14 aa, Mus sp.
DQLEWQSNQPWEQA

SEQ ID NO: 2477 - protein, 14 aa, Mus sp.
LEPYLEPRSPEARG

SEQ ID NO: 2478 - protein, 11 aa, Mus sp.
PIITPVAQENQ

SEQ ID NO: 2479 - protein, 16 aa, Mus sp.
VAVNWYAPLVAPISKD

SEQ ID NO: 2480 - protein, 15 aa, Mus sp.
NVLRIINEPTAAAIA

SEQ ID NO: 2481 - protein, 13 aa, Mus sp.
LFPQYTAPSILPS

SEQ ID NO: 2482 - protein, 16 aa, Mus sp.
GDTHFDSAEPWTVQNE

SEQ ID NO: 2483 - protein, 14 aa, Mus sp.
RSYSSPDITQALQE

SEQ ID NO: 2484 - protein, 15 aa, Mus sp.
LKRSYSSPDITQALQ

SEQ ID NO: 2485 - protein, 12 aa, Mus sp.
DNYRFAHTNIES

SEQ ID NO: 2486 - protein, 30 aa, Mus sp.
NVDPFKAVDTNRASMGQASPESKGFTDLLL

SEQ ID NO: 2487 - protein, 16 aa, Mus sp.
NLRDNYRFAHTNIESL

SEQ ID NO: 2488 - protein, 18 aa, Mus sp.
ELGRPDAEYWNSQPEILE

SEQ ID NO: 2489 - protein, 13 aa, Mus sp.
SLKYHFVTPLTSM

SEQ ID NO: 2490 - protein, 15 aa, Mus sp.
EEWGPFKAPHANRFI

SEQ ID NO: 2491 - protein, 13 aa, Mus sp.
ETTIWVSPSPILE

SEQ ID NO: 2492 - protein, 17 aa, Mus sp.
NNQAYHSPATALAIVDN

SEQ ID NO: 2493 - protein, 19 aa, Mus sp.
VVHKAFVEVNEEGTEAAAA

SEQ ID NO: 2494 - protein, 18 aa, Mus sp.
AGDAVAVAPAPAAAVEPA

SEQ ID NO: 2495 - protein, 16 aa, Mus sp.
IWRDYVPPTANLDQKD

SEQ ID NO: 2496 - protein, 20 aa, Mus sp.
KKVIEDRDHYIPNTLNPVFG

SEQ ID NO: 2497 - protein, 17 aa, Mus sp.
TKVEPYEVHNPVPLIVG

SEQ ID NO: 2498 - protein, 16 aa, Mus sp.
EDLNYHDPTVKHSTFH

SEQ ID NO: 2499 - protein, 18 aa, Mus sp.
HGLELEEPPLVLAAANVV

SEQ ID NO: 2500 - protein, 13 aa, Mus sp.
GFVLLGATANEVR

SEQ ID NO: 2501 - protein, 16 aa, Mus sp.
VDFDFAGPAIHGSAVF

SEQ ID NO: 2502 - protein, 15 aa, Mus sp.
APGGYVAPKAVWLPA

SEQ ID NO: 2503 - protein, 13 aa, Mus sp.
IDYTVPTVIAEEM

SEQ ID NO: 2504 - protein, 13 aa, Mus sp.
RSYSSPDITQALQ

SEQ ID NO: 2505 - protein, 17 aa, Mus sp.
AREGSYEAAKILLDHFA

SEQ ID NO: 2506 - protein, 16 aa, Mus sp.
VPTDKYYGAQTVRSTM

SEQ ID NO: 2507 - protein, 12 aa, Mus sp.
VTQFHPPHIEIQ

SEQ ID NO: 2508 - protein, 19 aa, Mus sp.
VPVPEFADSDPANIVHDFN

SEQ ID NO: 2509 - protein, 14 aa, Mus sp.
LRDWESPYSHDLDT

SEQ ID NO: 2510 - protein, 16 aa, Mus sp.
RRTDWEAPTGQPSAPG

SEQ ID NO: 2511 - protein, 13 aa, Mus sp.
WWRSPEPGPSAPG

SEQ ID NO: 2512 - protein, 16 aa, Mus sp.
KTLAYLFSGAAAAAEA

SEQ ID NO: 2513 - protein, 15 aa, Mus sp.
LKDREQHMFKISALE

SEQ ID NO: 2514 - protein, 16 aa, Mus sp.
LDNYLTSPLPEEVDET

SEQ ID NO: 2515 - protein, 18 aa, Mus sp.
TKKFRFEEPVVLPDLSDQ

SEQ ID NO: 2516 - protein, 14 aa, Mus sp.
ASVGAWTGPMGNWA

SEQ ID NO: 2517 - protein, 16 aa, Mus sp.
DSNFGAPSASVAAAPA

SEQ ID NO: 2518 - protein, 17 aa, Mus sp.
LNLAYIGAVPHSGIEQV

SEQ ID NO: 2519 - protein, 27 aa, Mus sp.
GNPTVEVDLYTAKGLFRAAVPSGASTG

SEQ ID NO: 2520 - protein, 20 aa, Mus sp.
NKPTVTVVSPLPNDSINPQP

SEQ ID NO: 2521 - protein, 15 aa, Mus sp.
AEEYEFLTPMEEAPK

SEQ ID NO: 2522 - protein, 12 aa, Mus sp.
YKVHNPVPLIVG

SEQ ID NO: 2523 - protein, 14 aa, Mus sp.
YTPYYVAPEVLGPE

SEQ ID NO: 2524 - protein, 17 aa, Mus sp.
DVKKPAAAPAPAPAPAP

SEQ ID NO: 2525 - protein, 16 aa, Mus sp.
IFGTHHNPAVWPDPEV

SEQ ID NO: 2526 - protein, 15 aa, Mus sp.
TIEFRGPNGLLVYQG

SEQ ID NO: 2527 - protein, 16 aa, Mus sp.
TPSYYTTSDAVISTET

SEQ ID NO: 2528 - protein, 15 aa, Mus sp.
DRRYNPPIIHQGFQD

SEQ ID NO: 2529 - protein, 16 aa, Mus sp.
VGETFHASQPSLTVDG

SEQ ID NO: 2530 - protein, 15 aa, Mus sp.
LKYHFVTPLTSMVVT

SEQ ID NO: 2531 - protein, 16 aa, Mus sp.
SPPPYAAYATPTPEVY

SEQ ID NO: 2532 - protein, 16 aa, Mus sp.
GIPYFETSAANGTNIS

SEQ ID NO: 2533 - protein, 13 aa, Mus sp.
GGYVAPKAVWLPA

SEQ ID NO: 2534 - protein, 18 aa, Mus sp.
KVEPYEVHNPVPLIVGSS

SEQ ID NO: 2535 - protein, 16 aa, Mus sp.
YTPYYVAPEVLGPEKY

SEQ ID NO: 2536 - protein, 16 aa, Mus sp.
DEGERYIAPTVLVDVQ

SEQ ID NO: 2537 - protein, 16 aa, Mus sp.
FDQGYEAPGVREAAAA

SEQ ID NO: 2538 - protein, 14 aa, Mus sp.
DTIEFRGPNGLLVY

SEQ ID NO: 2539 - protein, 17 aa, Mus sp.
DSGGFYISPRSTFSSLQ

SEQ ID NO: 2540 - protein, 30 aa, Mus sp.
GPSAPATPAAEAKAAEAAASAYYNPGNPHN

SEQ ID NO: 2541 - protein, 17 aa, Mus sp.
ITSSYYRGAHGIIVVYD

SEQ ID NO: 2542 - protein, 13 aa, Mus sp.
DQLFSGPLPGRLP

SEQ ID NO: 2543 - protein, 16 aa, Mus sp.
FPGQPGAPGAYPSAPG

SEQ ID NO: 2544 - protein, 13 aa, Mus sp.
VYHEPHIADAWPQ

SEQ ID NO: 2545 - protein, 19 aa, Mus sp.
VDSPDVVYSPETIEARYEY

SEQ ID NO: 2546 - protein, 14 aa, Mus sp.
IEGYVPSQADVAVF

SEQ ID NO: 2547 - protein, 14 aa, Mus sp.
DTEVYESPYADPEE

SEQ ID NO: 2548 - protein, 16 aa, Mus sp.
EVSSVEAPSVSPARHQ

SEQ ID NO: 2549 - protein, 16 aa, Mus sp.
DKQREEYQPATPGLGM

SEQ ID NO: 2550 - protein, 18 aa, Mus sp.
LPETFRRPQIDPAVEGFI

SEQ ID NO: 2551 - protein, 15 aa, Mus sp.
GERFEAPEALFQPHL

SEQ ID NO: 2552 - protein, 14 aa, Mus sp.
EVNSQYQEPDIIIH

SEQ ID NO: 2553 - protein, 14 aa, Mus sp.
GIFKGPTAENAEYL

SEQ ID NO: 2554 - protein, 15 aa, Mus sp.
APAPAEAPAAAEAPA

SEQ ID NO: 2555 - protein, 15 aa, Mus sp.
GEFDYSGSQAIKALK

SEQ ID NO: 2556 - protein, 16 aa, Mus sp.
GTPEYLAPEVLEDNDY

SEQ ID NO: 2557 - protein, 24 aa, Mus sp.
APAPAAPAAAEPQAEAPAAAASSE

SEQ ID NO: 2558 - protein, 27 aa, Mus sp.
KVIPELNGKLTGMAFRVPTPNVSVVDL

SEQ ID NO: 2559 - protein, 14 aa, Mus sp.
GIPVYRFVLPANAF

SEQ ID NO: 2560 - protein, 19 aa, Mus sp.
LPTELSNTYTFPNPAHPPG

SEQ ID NO: 2561 - protein, 12 aa, Mus sp.
YRGAQAAIVVYD

SEQ ID NO: 2562 - protein, 17 aa, Mus sp.
KSFVQNYPVVSIEDPFD

SEQ ID NO: 2563 - protein, 15 aa, Mus sp.
FYSKYSAPRLPAALE

SEQ ID NO: 2564 - protein, 16 aa, Mus sp.
LPKPIIWAEPGSVIAA

SEQ ID NO: 2565 - protein, 19 aa, Mus sp.
DLYTAKGLFRAAVPSGAST

SEQ ID NO: 2566 - protein, 16 aa, Mus sp.
AKVELVPPTPAEIPTA

SEQ ID NO: 2567 - protein, 13 aa, Mus sp.
VTQFHPPHIEIQM

SEQ ID NO: 2568 - protein, 17 aa, Mus sp.
IWRDYVPPTANLDQKDK

SEQ ID NO: 2569 - protein, 18 aa, Mus sp.
LLKGQMGLYIFQNTHAID

SEQ ID NO: 2570 - protein, 14 aa, Mus sp.
GVYASPSIAGSRPG

SEQ ID NO: 2571 - protein, 18 aa, Mus sp.
GELTYENVQVSPVPGGPP

SEQ ID NO: 2572 - protein, 14 aa, Mus sp.
YNEVHSPSVAVEMG

SEQ ID NO: 2573 - protein, 16 aa, Mus sp.
EKPVPAAPVPSPVAPA

SEQ ID NO: 2574 - protein, 17 aa, Mus sp.
EDPDGFSWPATLPSVYK

SEQ ID NO: 2575 - protein, 20 aa, Mus sp.
SANAIYSLAARPLPMPKLPP

SEQ ID NO: 2576 - protein, 21 aa, Mus sp.
GPDGKGMNPPSYYTQPVPVPN

SEQ ID NO: 2577 - protein, 14 aa, Mus sp.
VDQIYHLASPASPP

SEQ ID NO: 2578 - protein, 14 aa, Mus sp.
KQREEYQPATPGLG

SEQ ID NO: 2579 - protein, 16 aa, Mus sp.
RITPSYVAFTPEGERL

SEQ ID NO: 2580 - protein, 17 aa, Mus sp.
LGRPDAEYWNSQPEILE

SEQ ID NO: 2581 - protein, 16 aa, Mus sp.
LLEAKGPVTDVAYSHD

SEQ ID NO: 2582 - protein, 16 aa, Mus sp.
ESKATYSTNSPVWEEA

SEQ ID NO: 2583 - protein, 18 aa, Mus sp.
DYVELPPSVSQAAKSPPG

SEQ ID NO: 2584 - protein, 15 aa, Mus sp.
GDSYRSPWSNKYDPP

SEQ ID NO: 2585 - protein, 17 aa, Mus sp.
VPIYEGYALPHAILRLD

SEQ ID NO: 2586 - protein, 16 aa, Mus sp.
LNVLRIINEPTAAAIA

SEQ ID NO: 2587 - protein, 15 aa, Mus sp.
MPDMHFKAPKISMPD

SEQ ID NO: 2588 - protein, 13 aa, Mus sp.
LRDWESPYSHDLD

SEQ ID NO: 2589 - protein, 18 aa, Mus sp.
LRKYHLMQFSEVTKAVSE

SEQ ID NO: 2590 - protein, 17 aa, Mus sp.
DGNHTLFHNPHVNPLPT

SEQ ID NO: 2591 - protein, 15 aa, Mus sp.
EEVNIKTAEAQLAYE

SEQ ID NO: 2592 - protein, 16 aa, Mus sp.
VKDGYQMAQPVFAPKN

SEQ ID NO: 2593 - protein, 14 aa, Mus sp.
EPYEVHNPVPLIVG

SEQ ID NO: 2594 - protein, 13 aa, Mus sp.
TARYMAPEVLESR

SEQ ID NO: 2595 - protein, 12 aa, Mus sp.
NSYPVYLMEQQN

SEQ ID NO: 2596 - protein, 19 aa, Mus sp.
RASLEDFYGSPIPSVSLKL

SEQ ID NO: 2597 - protein, 17 aa, Mus sp.
ASAYYNPGNPHNVYMPT

SEQ ID NO: 2598 - protein, 14 aa, BOVIN
SVVVGPSVVAVPLP

SEQ ID NO: 2599 - protein, 18 aa, Mus sp.
SGAVIFNFPGTRNEVIPM

SEQ ID NO: 2600 - protein, 15 aa, Mus sp.
ADPSAFAAAAPAAAA

SEQ ID NO: 2601 - protein, 16 aa, Mus sp.
GALAASAPVVAVAGLG

SEQ ID NO: 2602 - protein, 14 aa, Mus sp.
TNDQNQNGNHTLPQ

SEQ ID NO: 2603 - protein, 15 aa, Mus sp.
LPTYDASKVTASGPG

SEQ ID NO: 2604 - protein, 17 aa, Mus sp.
TPAAPTSALGPKASPAP

SEQ ID NO: 2605 - protein, 17 aa, Mus sp.
KPPSYNVATTLPSYDEA

SEQ ID NO: 2606 - protein, 16 aa, Mus sp.
LTLPDFHVPEITIPEF

SEQ ID NO: 2607 - protein, 15 aa, Mus sp.
YGYHVNSPQVWSEPS

SEQ ID NO: 2608 - protein, 17 aa, Mus sp.
YVELPPSVSQAAKSPPG

SEQ ID NO: 2609 - protein, 13 aa, Mus sp.
YLPYKSPGINVDS

SEQ ID NO: 2610 - protein, 18 aa, Mus sp.
TRELWDSPEPASAPRTPQ

SEQ ID NO: 2611 - protein, 15 aa, Mus sp.
RDNMFSGSKINYTEN

SEQ ID NO: 2612 - protein, 12 aa, Mus sp.
FGPYYTEPVIAG

SEQ ID NO: 2613 - protein, 18 aa, Mus sp.
EDRRYNPPIIHQGFQDTS

SEQ ID NO: 2614 - protein, 9 aa, Mus sp.
FAYEGRDYI

SEQ ID NO: 2615 - protein, 14 aa, Mus sp.
DIYVWRGAQATLSN

SEQ ID NO: 2616 - protein, 16 aa, Mus sp.
NLRKMGAPEAGMAEYL

SEQ ID NO: 2617 - protein, 18 aa, Mus sp.
DEATRYLAPTILTDVDPN

SEQ ID NO: 2618 - protein, 12 aa, Mus sp.
VDFDFAGPAIHG

SEQ ID NO: 2619 - protein, 15 aa, Mus sp.
EVNSQYQEPDIIIHF

SEQ ID NO: 2620 - protein, 12 aa, Mus sp.
EPYLEPRSPEAR

SEQ ID NO: 2621 - protein, 15 aa, Mus sp.
VPTVPLLPPQVNQSL

SEQ ID NO: 2622 - protein, 13 aa, Mus sp.
RKIVYEGPELNHA

SEQ ID NO: 2623 - protein, 13 aa, Mus sp.
NSVFVAPAVTPVK

SEQ ID NO: 2624 - protein, 13 aa, Mus sp.
LPAAAQAPDALPA

SEQ ID NO: 2625 - protein, 20 aa, Mus sp.
TPSPESPDQWSSSSPHSNIS

SEQ ID NO: 2626 - protein, 17 aa, Mus sp.
HKLSYLTFIPSDDDIYD

SEQ ID NO: 2627 - protein, 18 aa, Mus sp.
LNVLRIINEPTAAAIAYG

SEQ ID NO: 2628 - protein, 14 aa, Mus sp.
IDIFARPTAGFITG

SEQ ID NO: 2629 - protein, 22 aa, Mus sp.
DYNRDGDSYRSPWSNKYDPPLE

SEQ ID NO: 2630 - protein, 23 aa, Mus sp.
GPPGFEDYVELPPSVSQAAKSPP

SEQ ID NO: 2631 - protein, 14 aa, Mus sp.
NVNIFKFIIPNIVK

SEQ ID NO: 2632 - protein, 17 aa, Mus sp.
KEVLDYSTPTTNGTPEA

SEQ ID NO: 2633 - protein, 19 aa, Mus sp.
GVPDDLLYSFPVVIKNKTW

SEQ ID NO: 2634 - protein, 14 aa, Mus sp.
LQPSGQLVSPRPAG

SEQ ID NO: 2635 - protein, 13 aa, Mus sp.
LEDFYGSPIPSVS

SEQ ID NO: 2636 - protein, 15 aa, Mus sp.
LPQDPTFHTPLDLYA

SEQ ID NO: 2637 - protein, 15 aa, Mus sp.
INKMDDPTVNWSNER

SEQ ID NO: 2638 - protein, 17 aa, Mus sp.
SQELVRAPTAALSPEPQ

SEQ ID NO: 2639 - protein, 16 aa, Mus sp.
GPVTPLSPSVLPSLPQ

SEQ ID NO: 2640 - protein, 16 aa, Mus sp.
MDLDIFNLPNVEISKD

SEQ ID NO: 2641 - protein, 18 aa, Mus sp.
QPSTSSLAAPTVEAAASA

SEQ ID NO: 2642 - protein, 14 aa, Mus sp.
LGEFDTPEAIWSSE

SEQ ID NO: 2643 - protein, 15 aa, Mus sp.
GGKDFNMPLTISSLK

SEQ ID NO: 2644 - protein, 14 aa, Mus sp.
YEWAPPVQNQALAR

SEQ ID NO: 2645 - protein, 13 aa, Mus sp.
ALPYDTPVPGYMN

SEQ ID NO: 2646 - protein, 13 aa, Mus sp.
VDFDFAGPAIHGS

SEQ ID NO: 2647 - protein, 14 aa, Mus sp.
SEEEYSAPLPTPAP

SEQ ID NO: 2648 - protein, 14 aa, Mus sp.
GLPDYSAPNPIKVT

SEQ ID NO: 2649 - protein, 15 aa, Mus sp.
LDKDSFSDPYAHVSF

SEQ ID NO: 2650 - protein, 16 aa, Mus sp.
SAPPHFHFGQTNRTPE

SEQ ID NO: 2651 - protein, 14 aa, Mus sp.
IEQSWGSPKVTKDG

SEQ ID NO: 2652 - protein, 16 aa, Mus sp.
ETETVFAPVIQAGMEA

SEQ ID NO: 2653 - protein, 15 aa, Mus sp.
LVEALEQPAPAIVSA

SEQ ID NO: 2654 - protein, 17 aa, Mus sp.
EPYAHAAPESIPATFED

SEQ ID NO: 2655 - protein, 21 aa, Mus sp.
KNVSINTVTYEWAPPVQNQAL

SEQ ID NO: 2656 - protein, 17 aa, Mus sp.
RTDWEAPTGQPSAPGPR

SEQ ID NO: 2657 - protein, 24 aa, Mus sp.
APAAPAAAEPQAEAPAAAASSEQS

SEQ ID NO: 2658 - protein, 15 aa, Mus sp.
VGINYQPPTVVPGGD

SEQ ID NO: 2659 - protein, 14 aa, Mus sp.
ERASFITPVPGGVG

SEQ ID NO: 2660 - protein, 13 aa, Mus sp.
LSIQWESSRPLLA

SEQ ID NO: 2661 - protein, 17 aa, Mus sp.
KIPPDVLQDMAVIAPML

SEQ ID NO: 2662 - protein, 17 aa, Mus sp.
IEDRDHYIPNTLNPVFG

SEQ ID NO: 2663 - protein, 13 aa, Mus sp.
EVWERPLSNLAWA

SEQ ID NO: 2664 - protein, 17 aa, Mus sp.
AGALAASAPVVAVAGLG

SEQ ID NO: 2665 - protein, 21 aa, Mus sp.
REPPPAYEPPAPAPAPLPPPS

SEQ ID NO: 2666 - protein, 13 aa, Mus sp.
VTYEWAPPVQNQA

SEQ ID NO: 2667 - protein, 17 aa, Mus sp.
KEIEVDSSPSVLEILDT

SEQ ID NO: 2668 - protein, 15 aa, Mus sp.
SPPPGGYGQPSVLPG

SEQ ID NO: 2669 - protein, 12 aa, Mus sp.
VEYEASAAGLIR

SEQ ID NO: 2670 - protein, 12 aa, Mus sp.
YEGYALPHAILR

SEQ ID NO: 2671 - protein, 14 aa, Mus sp.
YEGYALPHAILRLD

SEQ ID NO: 2672 - protein, 15 aa, Mus sp.
EWKDYKAGFGNLERE

SEQ ID NO: 2673 - protein, 17 aa, Mus sp.
QPGLNGAAAAAAAEAPD

SEQ ID NO: 2674 - protein, 13 aa, Mus sp.
SKNVFLSPMSISS

SEQ ID NO: 2675 - protein, 18 aa, Mus sp.
DPSKTGIGAPTISTGPPG

SEQ ID NO: 2676 - protein, 15 aa, Mus sp.
IDIFSTPSSSNSTSK

SEQ ID NO: 2677 - protein, 16 aa, Mus sp.
ADDTYTESYISTIGVD

SEQ ID NO: 2678 - protein, 14 aa, Mus sp.
ATNPIITPVAQENQ

SEQ ID NO: 2679 - protein, 13 aa, Mus sp.
FPIKWTAPEAINF

SEQ ID NO: 2680 - protein, 17 aa, Mus sp.
GEQKLFISPGLLPEAPT

SEQ ID NO: 2681 - protein, 17 aa, Mus sp.
GGKDFNMPLTISSLKDG

SEQ ID NO: 2682 - protein, 18 aa, Mus sp.
AQPPEYTFPSGSGAHFPQ

SEQ ID NO: 2683 - protein, 15 aa, Mus sp.
IKIAWESPQGQVSRY

SEQ ID NO: 2684 - protein, 16 aa, Mus sp.
KPVPAAPVPSPVAPAP

SEQ ID NO: 2685 - protein, 15 aa, Mus sp.
EGSYEAAKILLDHFA

SEQ ID NO: 2686 - protein, 15 aa, Mus sp.
RASIYQSVVINTSKE

SEQ ID NO: 2687 - protein, 16 aa, Mus sp.
GLPDYSAPNPIKVTHR

SEQ ID NO: 2688 - protein, 17 aa, Mus sp.
EPLSTVTAPDSPEAAEQ

SEQ ID NO: 2689 - protein, 16 aa, Mus sp.
EPYEVHNPVPLIVGSS

SEQ ID NO: 2690 - protein, 18 aa, Mus sp.
GPAGPGAVEGPNPASSPD

SEQ ID NO: 2691 - protein, 16 aa, Mus sp.
APNLHFHNPNPEIPAL

SEQ ID NO: 2692 - protein, 16 aa, Mus sp.
TGVDFIGSTVGLAKVS

SEQ ID NO: 2693 - protein, 15 aa, Mus sp.
VKDGYQMAQPVFAPK

SEQ ID NO: 2694 - protein, 16 aa, Mus sp.
WKALYTDPKSSETAAF

SEQ ID NO: 2695 - protein, 17 aa, Mus sp.
DFLKKWETPSQNTAQLD

SEQ ID NO: 2696 - protein, 14 aa, Mus sp.
QEVLAPQVVLSLGG

SEQ ID NO: 2697 - protein, 13 aa, Mus sp.
RYMAPEVLESRMN

SEQ ID NO: 2698 - protein, 13 aa, Mus sp.
IVKYNASLVTPEM

SEQ ID NO: 2699 - protein, 18 aa, Mus sp.
DSRTNTAYVGSAILSEET

SEQ ID NO: 2700 - protein, 16 aa, Mus sp.
APAQMAYPTAYPSFPG

SEQ ID NO: 2701 - protein, 11 aa, Mus sp.
RYMAPEVLESR

SEQ ID NO: 2702 - protein, 15 aa, Mus sp.
MFETFNTPAMYVAIQ

SEQ ID NO: 2703 - protein, 16 aa, Mus sp.
EPTGVYHQTTLHMALS

SEQ ID NO: 2704 - protein, 14 aa, Mus sp.
QIDYTVPTVIAEEM

SEQ ID NO: 2705 - protein, 15 aa, Mus sp.
LPYKSPGINVDSSYK

SEQ ID NO: 2706 - protein, 16 aa, Mus sp.
LVFDVTAPNTFKTLDS

SEQ ID NO: 2707 - protein, 15 aa, Mus sp.
GGYKFSAPVVPSSFN

SEQ ID NO: 2708 - protein, 15 aa, Mus sp.
SCKYSHLITSHQFQP

SEQ ID NO: 2709 - protein, 17 aa, Mus sp.
TPRDYYFALAHTVRDHL

SEQ ID NO: 2710 - protein, 14 aa, Mus sp.
YTIPFYTPIPNGLY

SEQ ID NO: 2711 - protein, 16 aa, Mus sp.
APMYYRGAQAAIVVYD

SEQ ID NO: 2712 - protein, 15 aa, Mus sp.
ETVAYLQAHALTTEG

SEQ ID NO: 2713 - protein, 13 aa, Mus sp.
RRYNPPIIHQGFQ

SEQ ID NO: 2714 - protein, 17 aa, Mus sp.
SHPQYAEPGAEAAFSGR

SEQ ID NO: 2715 - protein, 13 aa, Mus sp.
DEATRYLAPTILT

SEQ ID NO: 2716 - protein, 13 aa, Mus sp.
GGHKLGLALELEA

SEQ ID NO: 2717 - protein, 16 aa, Mus sp.
SNDVHMYLPTKLFQPS

SEQ ID NO: 2718 - protein, 19 aa, Mus sp.
NPQMPQYTSPQPGSALSPR

SEQ ID NO: 2719 - protein, 13 aa, Mus sp.
VRVDEYDYSKPIQ

SEQ ID NO: 2720 - protein, 18 aa, Mus sp.
IDTAAKFIGAGAATVGVA

SEQ ID NO: 2721 - protein, 15 aa, Mus sp.
VVFEWKDPFIQKVQD

SEQ ID NO: 2722 - protein, 15 aa, Mus sp.
DSVVFAGPAGNSVET

SEQ ID NO: 2723 - protein, 16 aa, Mus sp.
APAAAEAPAAAEAPAA

SEQ ID NO: 2724 - protein, 15 aa, Mus sp.
LPNYSSPNALVLNTK

SEQ ID NO: 2725 - protein, 16 aa, Mus sp.
YQMYGGPVVLVAHSMG

SEQ ID NO: 2726 - protein, 13 aa, Mus sp.
APFDWEGAQASQA

SEQ ID NO: 2727 - protein, 15 aa, Mus sp.
KGQDHVDFSQPEPHT

SEQ ID NO: 2728 - protein, 17 aa, Mus sp.
GPKVDIEGPNVNIEGPE

SEQ ID NO: 2729 - protein, 16 aa, BOVIN
AVPDAAGPTPSAAGPP

SEQ ID NO: 2730 - protein, 15 aa, Mus sp.
DNYLTSPLPEEVDET

SEQ ID NO: 2731 - protein, 13 aa, Mus sp.
QEVLAPQVVLSLG

SEQ ID NO: 2732 - protein, 15 aa, Mus sp.
TPYSTPQMSPATTPA

SEQ ID NO: 2733 - protein, 16 aa, Mus sp.
VTEDNVFEAPTLVKVF

SEQ ID NO: 2734 - protein, 16 aa, Mus sp.
IDNPDYKGTWIHPEID

SEQ ID NO: 2735 - protein, 12 aa, Mus sp.
TPFWMAPEVIQE

SEQ ID NO: 2736 - protein, 8 aa, Mus sp.
ATLVFHNL

SEQ ID NO: 2737 - protein, 11 aa, Mus sp.
DYVPPTANLDQ

SEQ ID NO: 2738 - protein, 14 aa, Mus sp.
IEVWERPLSNLAWA

SEQ ID NO: 2739 - protein, 14 aa, Mus sp.
GIDPYDQPNAIYIE

SEQ ID NO: 2740 - protein, 16 aa, Mus sp.
FELKPRSPQVIPIEEF

SEQ ID NO: 2741 - protein, 13 aa, Mus sp.
EVSSVEAPSVSPA

SEQ ID NO: 2742 - protein, 14 aa, Mus sp.
LPNVQVEGPTPNRP

SEQ ID NO: 2743 - protein, 20 aa, Mus sp.
SPPHVQFTYQQPQPLSVEPR

SEQ ID NO: 2744 - protein, 8 aa, Mus sp.
ITGYFPSM

SEQ ID NO: 2745 - protein, 15 aa, Mus sp.
ITPDIIINPHAIPSR

SEQ ID NO: 2746 - protein, 16 aa, Mus sp.
FNLDAEAPAVLSGPPG

SEQ ID NO: 2747 - protein, 14 aa, Mus sp.
TPYGAYNGPVPGYQ

SEQ ID NO: 2748 - protein, 15 aa, Mus sp.
KQREEYQPATPGLGM

SEQ ID NO: 2749 - protein, 24 aa, Mus sp.
TPSPESPDQWSSSSPHSNISDWSE

SEQ ID NO: 2750 - protein, 16 aa, Mus sp.
DWLRYSPAYAHLVAPG

SEQ ID NO: 2751 - protein, 12 aa, Mus sp.
KLQMEAPHIIVG

SEQ ID NO: 2752 - protein, 16 aa, Mus sp.
GNSEFDPPGPNVATTT

SEQ ID NO: 2753 - protein, 18 aa, Mus sp.
SPPPGGYGQPSVLPGGYP

SEQ ID NO: 2754 - protein, 15 aa, Mus sp.
NDLQYAAPGGLIGVG

SEQ ID NO: 2755 - protein, 16 aa, Mus sp.
EVAQLISPVTTASMSG

SEQ ID NO: 2756 - protein, 13 aa, Mus sp.
GGLPDYSAPNPIK

SEQ ID NO: 2757 - protein, 21 aa, Mus sp.
LNGKLTGMAFRVPTPNVSVVD

SEQ ID NO: 2758 - protein, 15 aa, Mus sp.
VPWNFHEPQPGQYEF

SEQ ID NO: 2759 - protein, 14 aa, Mus sp.
SPNYAAPEVISGRL

SEQ ID NO: 2760 - protein, 15 aa, Mus sp.
LEHSNDPSAIMAPFY

SEQ ID NO: 2761 - protein, 16 aa, Mus sp.
IKVYWDAPSPAPDHIR

SEQ ID NO: 2762 - protein, 16 aa, Mus sp.
IDPYDQPNAIYIERHE

SEQ ID NO: 2763 - protein, 17 aa, Mus sp.
QPPEYTFPSGSGAHFPQ

SEQ ID NO: 2764 - protein, 16 aa, Mus sp.
TPEYLAPEIILSKGYN

SEQ ID NO: 2765 - protein, 17 aa, Mus sp.
KDPFWWNGAEPIWVTNQ

SEQ ID NO: 2766 - protein, 18 aa, Mus sp.
APSEERVYMVGKANSVFE

SEQ ID NO: 2767 - protein, 12 aa, Mus sp.
LDYYDSPSVNAR

SEQ ID NO: 2768 - protein, 13 aa, Mus sp.
LIEVSSPITLQAL

SEQ ID NO: 2769 - protein, 14 aa, Mus sp.
VADKEFHAPLIIDE

SEQ ID NO: 2770 - protein, 15 aa, Mus sp.
ETVVTPEAAPEKNPV

SEQ ID NO: 2771 - protein, 16 aa, Mus sp.
RLDNYDAPDIANIAIS

SEQ ID NO: 2772 - protein, 17 aa, Mus sp.
YAKVELVPPTPAEIPTA

SEQ ID NO: 2773 - protein, 19 aa, Mus sp.
DSRTNTAYVGSAILSEETA

SEQ ID NO: 2774 - protein, 9 aa, Mus sp.
GRDFYKILG

SEQ ID NO: 2775 - protein, 16 aa, Mus sp.
LDIYVWRGAQATLSNT

SEQ ID NO: 2776 - protein, 15 aa, Mus sp.
SELLRSAQPASAEPR

SEQ ID NO: 2777 - protein, 15 aa, Mus sp.
RSQVTPSVPSEALDD

SEQ ID NO: 2778 - protein, 18 aa, Mus sp.
NPWGEVEWKGPWSDSSYE

SEQ ID NO: 2779 - protein, 21 aa, Mus sp.
GPGEPSPVSETVVTPEAAPEK

SEQ ID NO: 2780 - protein, 16 aa, Mus sp.
QLEALVGPEANVGPYG

SEQ ID NO: 2781 - protein, 15 aa, Mus sp.
TITVQGPKSSRSLPV

SEQ ID NO: 2782 - protein, 14 aa, Mus sp.
LLYNVPAVAEEIQD

SEQ ID NO: 2783 - protein, 16 aa, Mus sp.
GPVPEFSGATVERVSE

SEQ ID NO: 2784 - protein, 19 aa, Mus sp.
EPTSSSPYNPPDLEEAAKT

SEQ ID NO: 2785 - protein, 16 aa, Mus sp.
LNLEYHSSMIADAVKK

SEQ ID NO: 2786 - protein, 15 aa, Mus sp.
ESKATYSTNSPVWEE

SEQ ID NO: 2787 - protein, 13 aa, Mus sp.
NIYWTDSVPGSVS

SEQ ID NO: 2788 - protein, 15 aa, Mus sp.
DVNTYNAAIAYTIVS

SEQ ID NO: 2789 - protein, 16 aa, Mus sp.
FPDNYNSPTPYKIQYN

SEQ ID NO: 2790 - protein, 16 aa, Mus sp.
SSPEFKGSQASLSDSL

SEQ ID NO: 2791 - protein, 19 aa, Mus sp.
KAHAFSVEALIGAEKQQQL

SEQ ID NO: 2792 - protein, 13 aa, Mus sp.
YAVEKNPNAVVTL

SEQ ID NO: 2793 - protein, 17 aa, Mus sp.
NSNKQYLFPETLVIGEK

SEQ ID NO: 2794 - protein, 16 aa, Mus sp.
LLLHWQPPLSHNGVLT

SEQ ID NO: 2795 - protein, 18 aa, Mus sp.
NPEKHIYSSITTWETTER

SEQ ID NO: 2796 - protein, 16 aa, Mus sp.
ASFKDPKISTSLPVLD

SEQ ID NO: 2797 - protein, 14 aa, Mus sp.
GPKPFSAPKPQTSP

SEQ ID NO: 2798 - protein, 18 aa, Mus sp.
SIPEAQWQSSLARTSSAE

SEQ ID NO: 2799 - protein, 14 aa, Mus sp.
HVEGYEGSAASIST

SEQ ID NO: 2800 - protein, 16 aa, Mus sp.
QSTDYGNFLANEASPL

SEQ ID NO: 2801 - protein, 20 aa, Mus sp.
RPPGPPPAPQPPSPAPSPPP

SEQ ID NO: 2802 - protein, 16 aa, Mus sp.
DKRLEFEASQVLGTMD

SEQ ID NO: 2803 - protein, 15 aa, Mus sp.
YPDSWSTPHSYFSLK

SEQ ID NO: 2804 - protein, 15 aa, Mus sp.
ADDYTTANARKLIDE

SEQ ID NO: 2805 - protein, 16 aa, Mus sp.
VVDNVSSPETIVVFNG

SEQ ID NO: 2806 - protein, 14 aa, Mus sp.
GFPYEGPAPLEAIA

SEQ ID NO: 2807 - protein, 17 aa, Mus sp.
NPEKHIYSSITTWETTE

SEQ ID NO: 2808 - protein, 19 aa, Mus sp.
DPEDHTVSFVQPNGAIFEP

SEQ ID NO: 2809 - protein, 15 aa, Mus sp.
VPATFAPSPTPAVVS

SEQ ID NO: 2810 - protein, 19 aa, Mus sp.
APGKKVIYSQPSTRSEGEF

SEQ ID NO: 2811 - protein, 15 aa, Mus sp.
IGRTWNDPSVQQDIK

SEQ ID NO: 2812 - protein, 13 aa, Mus sp.
KFVYAGSNSGVVQ

SEQ ID NO: 2813 - protein, 12 aa, Mus sp.
DEATRYLAPTIL

SEQ ID NO: 2814 - protein, 17 aa, Mus sp.
RPVQFPYVTPAPHEPVK

SEQ ID NO: 2815 - protein, 18 aa, Mus sp.
ITRDLKWGTPVPLEGFED

SEQ ID NO: 2816 - protein, 13 aa, Mus sp.
GGHKLGLGLEFQA

SEQ ID NO: 2817 - protein, 18 aa, Mus sp.
IDTSLKAPDVDVSVAGPD

SEQ ID NO: 2818 - protein, 16 aa, Mus sp.
ENLYPYLGPSTLRDRP

SEQ ID NO: 2819 - protein, 17 aa, Mus sp.
ARPDDEVGPAVAPGHPL

SEQ ID NO: 2820 - protein, 15 aa, Mus sp.
SLQAFSNPSAGISVD

SEQ ID NO: 2821 - protein, 19 aa, Mus sp.
GPAGPGAVEGPNPASSPDA

SEQ ID NO: 2822 - protein, 18 aa, Mus sp.
GDLSWHPALTTKSKMRDP

SEQ ID NO: 2823 - protein, 22 aa, Mus sp.
IDVDPQEDPQNAPDVNYVVENP

SEQ ID NO: 2824 - protein, 18 aa, Mus sp.
VADKEFHAPLIIDENGVH

SEQ ID NO: 2825 - protein, 15 aa, Mus sp.
ADFHYAASKALRVPA

SEQ ID NO: 2826 - protein, 17 aa, Mus sp.
NRPAFMPSEGRMVSDIN

SEQ ID NO: 2827 - protein, 16 aa, Mus sp.
TTVEYLAPWANQIDMA

SEQ ID NO: 2828 - protein, 16 aa, Mus sp.
SPVSETVVTPEAAPEK

SEQ ID NO: 2829 - protein, 14 aa, Mus sp.
VGGERFEAPEALFQ

SEQ ID NO: 2830 - protein, 16 aa, Mus sp.
FADDYTTANARKLIDE

SEQ ID NO: 2831 - protein, 13 aa, Mus sp.
GTPEYLAPEIILS

SEQ ID NO: 2832 - protein, 12 aa, Mus sp.
DAEYWNSQPEIL

SEQ ID NO: 2833 - protein, 21 aa, Mus sp.
GEMDEATRYLAPTILTDVDPN

SEQ ID NO: 2834 - protein, 14 aa, Mus sp.
SIASFKDPKISTSL

SEQ ID NO: 2835 - protein, 22 aa, Mus sp.
VDHNTRTTTWQRPTAEYVRNYE

SEQ ID NO: 2836 - protein, 12 aa, Mus sp.
IVYWMTSQPSDA

SEQ ID NO: 2837 - protein, 15 aa, Mus sp.
RDGDSYRSPWSNKYD

SEQ ID NO: 2838 - protein, 17 aa, Mus sp.
EGNHYFYSPYPTKTQTM

SEQ ID NO: 2839 - protein, 17 aa, Mus sp.
CFPPSERFMKYLLNFIS

SEQ ID NO: 2840 - protein, 15 aa, Mus sp.
IVYWMTSQPSDAVRF

SEQ ID NO: 2841 - protein, 24 aa, Mus sp.
EETELDQLFSGPLPGRLPVNHRPF

SEQ ID NO: 2842 - protein, 20 aa, Mus sp.
EPSKLKRSYSSPDITQALQE

SEQ ID NO: 2843 - protein, 17 aa, Mus sp.
KPWNQYRLPKTLIPDSY

SEQ ID NO: 2844 - protein, 15 aa, Mus sp.
AAVAWEAGKPLSIEE

SEQ ID NO: 2845 - protein, 13 aa, Mus sp.
GPVPWLGPQTDEA

SEQ ID NO: 2846 - protein, 14 aa, Mus sp.
VEALEQPAPAIVSA

SEQ ID NO: 2847 - protein, 15 aa, Mus sp.
TPDYISPEILQAMED

SEQ ID NO: 2848 - protein, 15 aa, Mus sp.
NLLLQSPGVLTAARE

SEQ ID NO: 2849 - protein, 16 aa, Mus sp.
EEEYYAEPGVTEAEPV

SEQ ID NO: 2850 - protein, 14 aa, Mus sp.
APVPSPVAPAPVPS

SEQ ID NO: 2851 - protein, 15 aa, Mus sp.
GGQVYAFPSSQSVTE

SEQ ID NO: 2852 - protein, 13 aa, Mus sp.
EDNVFEAPTLVKV

SEQ ID NO: 2853 - protein, 14 aa, Mus sp.
KNLDYVATSIHEAV

SEQ ID NO: 2854 - protein, 16 aa, Mus sp.
VQAFTHAPAALEADRG

SEQ ID NO: 2855 - protein, 24 aa, Mus sp.
YTAKGLFRAAVPSGASTGIYEALE

SEQ ID NO: 2856 - protein, 15 aa, Mus sp.
TPYYVAPEVLGPEKY

SEQ ID NO: 2857 - protein, 11 aa, Mus sp.
SYPVYLMEQQN

SEQ ID NO: 2858 - protein, 17 aa, Mus sp.
EAEEVYRNSMPASSFQQ

SEQ ID NO: 2859 - protein, 15 aa, Mus sp.
NINQWTASIVEQSIT

SEQ ID NO: 2860 - protein, 17 aa, Mus sp.
DDDVYRAPPIDRSILPT

SEQ ID NO: 2861 - protein, 15 aa, Mus sp.
FQFGYNTGVINAPET

SEQ ID NO: 2862 - protein, 14 aa, Mus sp.
AVKSKYKASIAALE

SEQ ID NO: 2863 - protein, 14 aa, Mus sp.
DFVAWATGEPNFAN

SEQ ID NO: 2864 - protein, 15 aa, Mus sp.
GKKFTAPHILIATGG

SEQ ID NO: 2865 - protein, 18 aa, Mus sp.
EDYVELPPSVSQAAKSPP

SEQ ID NO: 2866 - protein, 18 aa, Mus sp.
RPDAEYWNSQPEILERTR

SEQ ID NO: 2867 - protein, 15 aa, Mus sp.
VTEYTPRSWNFLHTL

SEQ ID NO: 2868 - protein, 15 aa, Mus sp.
FATGFSHPLTQSAVM

SEQ ID NO: 2869 - protein, 18 aa, Mus sp.
IKPGTTVEYLAPWANQID

SEQ ID NO: 2870 - protein, 14 aa, Mus sp.
INPEEYEHPNPWKE

SEQ ID NO: 2871 - protein, 20 aa, Mus sp.
KNPTDEYLDAMMNEAPGPIN

SEQ ID NO: 2872 - protein, 13 aa, Mus sp.
KGPAFVNPLIPEN

SEQ ID NO: 2873 - protein, 15 aa, Mus sp.
GYPVLYPTGWSSSDN

SEQ ID NO: 2874 - protein, 15 aa, Mus sp.
LEALVGPEANVGPYG

SEQ ID NO: 2875 - protein, 16 aa, Mus sp.
AAEEFKVPAATSAIIT

SEQ ID NO: 2876 - protein, 17 aa, Listeria monocytogenes
TTVKFTLPTVAPAFENT

SEQ ID NO: 2877 - protein, 13 aa, Mus sp.
EDRRYNPPIIHQG

SEQ ID NO: 2878 - protein, 20 aa, Mus sp.
SPESPDQWSSSSPHSASDWS

SEQ ID NO: 2879 - protein, 14 aa, Mus sp.
AGEFDYSGSQAIKA

SEQ ID NO: 2880 - protein, 18 aa, Mus sp.
DLPNSFDGPVTITIVNRD

SEQ ID NO: 2881 - protein, 15 aa, Mus sp.
LPTTFQGATASTSYG

SEQ ID NO: 2882 - protein, 18 aa, Mus sp.
EETAFQTPKPSQTPSVPP

SEQ ID NO: 2883 - protein, 18 aa, Mus sp.
DPAKGRIYQGTEADSIFS

SEQ ID NO: 2884 - protein, 13 aa, Mus sp.
LDEFYSDPHAVAG

SEQ ID NO: 2885 - protein, 15 aa, Mus sp.
INDYKGAVIVVSHDA

SEQ ID NO: 2886 - protein, 13 aa, Mus sp.
TPWKAPIVWEGTY

SEQ ID NO: 2887 - protein, 19 aa, Mus sp.
IARQNFTEPTAIQAQGWPV

SEQ ID NO: 2888 - protein, 14 aa, Mus sp.
IGDSNFGAPSASVA

SEQ ID NO: 2889 - protein, 16 aa, Mus sp.
GYPTAYPAAAPAYNPS

SEQ ID NO: 2890 - protein, 16 aa, Mus sp.
VYTRYHCSLPVPEPSA

SEQ ID NO: 2891 - protein, 14 aa, Mus sp.
EDKVYWTDVINEAI

SEQ ID NO: 2892 - protein, 18 aa, Mus sp.
DPKYRTWAWEAVEALESH

SEQ ID NO: 2893 - protein, 12 aa, Mus sp.
RLNSPVTIPAVM

SEQ ID NO: 2894 - protein, 16 aa, Mus sp.
ISALFVTPKTAGAQVV

SEQ ID NO: 2895 - protein, 14 aa, Mus sp.
YPNSFSAPEQQRSA

SEQ ID NO: 2896 - protein, 20 aa, Mus sp.
SPGFSSEVYTFPVPERHLER

SEQ ID NO: 2897 - protein, 17 aa, Mus sp.
YTPYYVAPEVLGPEKYD

SEQ ID NO: 2898 - protein, 13 aa, Mus sp.
EFMGPEVAPALPD

SEQ ID NO: 2899 - protein, 16 aa, Mus sp.
VTRQTTQYPEANALVR

SEQ ID NO: 2900 - protein, 18 aa, Mus sp.
IPKVVKSPSSLPAKPLVP

SEQ ID NO: 2901 - protein, 16 aa, Mus sp.
KPSTFAYPAPLEVPKE

SEQ ID NO: 2902 - protein, 22 aa, Mus sp.
RPDAEYWNSQPEILERTRAELD

SEQ ID NO: 2903 - protein, 16 aa, Mus sp.
LHLRFSAPQIENEPET

SEQ ID NO: 2904 - protein, 19 aa, Mus sp.
APSEERVYMVGKANSVFED

SEQ ID NO: 2905 - protein, 18 aa, Mus sp.
KGPAFVNPLIPENKEEEE

SEQ ID NO: 2906 - protein, 12 aa, Mus sp.
GLPDYSAPNPIK

SEQ ID NO: 2907 - protein, 14 aa, Mus sp.
GAWTGPMGNWAMFT

SEQ ID NO: 2908 - protein, 16 aa, Mus sp.
AIVDPYNNPVPRGLEA

SEQ ID NO: 2909 - protein, 15 aa, Mus sp.
TPSYYTTSDAVISTE

SEQ ID NO: 2910 - protein, 16 aa, Mus sp.
LIDQCSHFEESLIKNL

SEQ ID NO: 2911 - protein, 16 aa, Mus sp.
TSSYYRGAHGIIVVYD

SEQ ID NO: 2912 - protein, 13 aa, Mus sp.
FDFAGPAIHGSAV

SEQ ID NO: 2913 - protein, 18 aa, Mus sp.
YDRALAVVYSVITPFLNP

SEQ ID NO: 2914 - protein, 13 aa, Mus sp.
EQIYYAGPVNNPG

SEQ ID NO: 2915 - protein, 12 aa, Mus sp.
GTPDYIAPEILQ

SEQ ID NO: 2916 - protein, 21 aa, Mus sp.
SDEGERYIAPTVLVDVQETEP

SEQ ID NO: 2917 - protein, 19 aa, Mus sp.
GDLSWHPALTTKSKMRDPH

SEQ ID NO: 2918 - protein, 17 aa, Mus sp.
SPPGGDFSDPVTSATLG

SEQ ID NO: 2919 - protein, 13 aa, Mus sp.
DTIEFRGPNGLLV

SEQ ID NO: 2920 - protein, 18 aa, Mus sp.
GEEAGAYDGPRTADGIVS

SEQ ID NO: 2921 - protein, 14 aa, Mus sp.
APYQGPDAAPGALD

SEQ ID NO: 2922 - protein, 15 aa, Mus sp.
KQIDYTVPTVIAEEM

SEQ ID NO: 2923 - protein, 13 aa, Mus sp.
DNMFSGSKINYTE

SEQ ID NO: 2924 - protein, 14 aa, Mus sp.
SPHPYQLPQALAPH

SEQ ID NO: 2925 - protein, 16 aa, Mus sp.
SARTVITPDPNLSIDQ

SEQ ID NO: 2926 - protein, 17 aa, Mus sp.
IPEAQWQSSLARTSSAE

SEQ ID NO: 2927 - protein, 15 aa, Mus sp.
LEKAVYQGPGSSPVK

SEQ ID NO: 2928 - protein, 19 aa, Mus sp.
VPEESSSFEGAQVEHSTSR

SEQ ID NO: 2929 - protein, 15 aa, Mus sp.
IVDPYNNPVPRGLEA

SEQ ID NO: 2930 - protein, 12 aa, Mus sp.
VTPWKAPIVWEG

SEQ ID NO: 2931 - protein, 17 aa, Mus sp.
GIPVYRFVLPANAFASP

SEQ ID NO: 2932 - protein, 20 aa, Mus sp.
GPHSMRYFETAVSRPGLEEP

SEQ ID NO: 2933 - protein, 13 aa, Mus sp.
DQLEWQSNQPWEQ

SEQ ID NO: 2934 - protein, 17 aa, Mus sp.
APAPAAAPAAAPAAAPE

SEQ ID NO: 2935 - protein, 15 aa, Mus sp.
EKPVPAAPVPSPVAP

SEQ ID NO: 2936 - protein, 15 aa, Mus sp.
RDYVPPTANLDQKDK

SEQ ID NO: 2937 - protein, 17 aa, Mus sp.
DHDVKIWAPTAEASTEL

SEQ ID NO: 2938 - protein, 16 aa, Mus sp.
VDVFYSSGIPATARPY

SEQ ID NO: 2939 - protein, 13 aa, Mus sp.
LAWNAPAVLQKPY

SEQ ID NO: 2940 - protein, 17 aa, Mus sp.
DVRAVAHSPTALISGGT

SEQ ID NO: 2941 - protein, 27 aa, Mus sp.
APTPSTPAPTPAATPAASPAPVSSDPA

SEQ ID NO: 2942 - protein, 11 aa, Mus sp.
YTIPFYTPIPN

SEQ ID NO: 2943 - protein, 15 aa, Mus sp.
SFPKFKGSLALRTLD

SEQ ID NO: 2944 - protein, 16 aa, Mus sp.
DVSAYIPTNVISITDG

SEQ ID NO: 2945 - protein, 18 aa, Mus sp.
EPSPVSETVVTPEAAPEK

SEQ ID NO: 2946 - protein, 16 aa, Mus sp.
VGPDYAHAEARKSPAL

SEQ ID NO: 2947 - protein, 14 aa, Mus sp.
SRVQIYHNPTANSF

SEQ ID NO: 2948 - protein, 14 aa, Mus sp.
ELVRAPTAALSPEP

SEQ ID NO: 2949 - protein, 16 aa, Mus sp.
VTNLRKMGAPEAGMAE

SEQ ID NO: 2950 - protein, 16 aa, Mus sp.
VGPVPWLGPQTDEAIK

SEQ ID NO: 2951 - protein, 11 aa, Mus sp.
EGYALPHAILR

SEQ ID NO: 2952 - protein, 17 aa, Mus sp.
GKKVIYSQPSTRSEGEF

SEQ ID NO: 2953 - protein, 15 aa, Mus sp.
ALPYDTPVPGYMNNT

SEQ ID NO: 2954 - protein, 13 aa, Mus sp.
LDNYDAPDIANIA

SEQ ID NO: 2955 - protein, 19 aa, Mus sp.
LPKEELYMPPLVIKVIDHR

SEQ ID NO: 2956 - protein, 14 aa, Mus sp.
NPPSYYTQPVPVPN

SEQ ID NO: 2957 - protein, 16 aa, Mus sp.
ESKIRYKTSEPVWEEN

SEQ ID NO: 2958 - protein, 16 aa, Mus sp.
LSIQWESSRPLLASIE

SEQ ID NO: 2959 - protein, 16 aa, Mus sp.
IDWTYRPPSSSRTESI

SEQ ID NO: 2960 - protein, 15 aa, Mus sp.
DKQREEYQPATPGLG

SEQ ID NO: 2961 - protein, 19 aa, Mus sp.
HPDKGGSPYIAAKINEAKD

SEQ ID NO: 2962 - protein, 16 aa, Mus sp.
VLPANAFASPLQNPDN

SEQ ID NO: 2963 - protein, 17 aa, Mus sp.
GTPDYISPEVLKSQGGD

SEQ ID NO: 2964 - protein, 16 aa, Mus sp.
KELEEQLGPVAEETRA

SEQ ID NO: 2965 - protein, 22 aa, Listeria monocytogenes
RDNYLFQLYEATGTPIHPMSPF

SEQ ID NO: 2966 - protein, 19 aa, Mus sp.
AGEVKAFFESHPAPSAERT

SEQ ID NO: 2967 - protein, 14 aa, Mus sp.
WTFSTTGALESAVA

SEQ ID NO: 2968 - protein, 17 aa, Mus sp.
EVNSQYQEPDIIIHFAR

SEQ ID NO: 2969 - protein, 14 aa, Mus sp.
FYQHPNLMRALGMH

SEQ ID NO: 2970 - protein, 16 aa, Mus sp.
VNGKKFTAPHILIATG

SEQ ID NO: 2971 - protein, 14 aa, Mus sp.
GVAYEAPSLATGYG

SEQ ID NO: 2972 - protein, 15 aa, Mus sp.
GINYQPPTVVPGGDL

SEQ ID NO: 2973 - protein, 16 aa, Mus sp.
KERYSYVCPDLVKEFN

SEQ ID NO: 2974 - protein, 13 aa, Mus sp.
LALPYDTPVPGYM

SEQ ID NO: 2975 - protein, 14 aa, Mus sp.
LVLDFVTPTPLGTR

SEQ ID NO: 2976 - protein, 14 aa, Mus sp.
GVDFIGSTVGLAKV

SEQ ID NO: 2977 - protein, 13 aa, Mus sp.
EKEDRRYNPPIIH

SEQ ID NO: 2978 - protein, 11 aa, Mus sp.
AELLNSKLPRW

SEQ ID NO: 2979 - protein, 16 aa, Mus sp.
YVELPPSVSQAAKSPP

SEQ ID NO: 2980 - protein, 19 aa, Mus sp.
GGDTHFDSAEPWTVQNEDL

SEQ ID NO: 2981 - protein, 17 aa, Mus sp.
DGKKFKLEAPDADELPR

SEQ ID NO: 2982 - protein, 19 aa, Mus sp.
LPPASLPESTPVPSSSPPP

SEQ ID NO: 2983 - protein, 18 aa, Mus sp.
GPRAEEYEFLTPMEEAPK

SEQ ID NO: 2984 - protein, 14 aa, Mus sp.
AYSSNQTHNLNPLL

SEQ ID NO: 2985 - protein, 28 aa, Mus sp.
LLDFGSLSNLQVTQPTVGMNFKTPRGAV

SEQ ID NO: 2986 - protein, 20 aa, BOVIN
GPPVASVVVGPSVVAVPLPL

SEQ ID NO: 2987 - protein, 19 aa, Mus sp.
DPSQKQNLLAPQNAVSSEE

SEQ ID NO: 2988 - protein, 15 aa, Mus sp.
SKEAFQEALAAAGDK

SEQ ID NO: 2989 - protein, 14 aa, Mus sp.
SFFWNVAPGAESAV

SEQ ID NO: 2990 - protein, 15 aa, Mus sp.
DPTFHTPLDLYAYAR

SEQ ID NO: 2991 - protein, 15 aa, Mus sp.
LPNSFDGPVTITIVN

SEQ ID NO: 2992 - protein, 18 aa, Mus sp.
EPTTLFKTASALRSSAPL

SEQ ID NO: 2993 - protein, 15 aa, Mus sp.
NLDYWTYPGSLTTPP

SEQ ID NO: 2994 - protein, 16 aa, Mus sp.
LQFGYNTGVINAPQKV

SEQ ID NO: 2995 - protein, 18 aa, Listeria monocytogenes
EILLQKPNGERLTSFITL

SEQ ID NO: 2996 - protein, 10 aa, Mus sp.
IPFYTPIPNG

SEQ ID NO: 2997 - protein, 17 aa, Mus sp.
EPKESVLPPKTSAAAQL

SEQ ID NO: 2998 - protein, 19 aa, BOVIN
APSAVPDAAGPTPSAAGPP

SEQ ID NO: 2999 - protein, 15 aa, Mus sp.
LGVAYEAPSLATGYG

SEQ ID NO: 3000 - protein, 30 aa, Mus sp.
LDENLPNKPTVTVVSPLPNDSINPQPSPDG

SEQ ID NO: 3001 - protein, 14 aa, Mus sp.
TNTAYVGSAILSEE

SEQ ID NO: 3002 - protein, 16 aa, Mus sp.
APINAFIGGLAAQEVM

SEQ ID NO: 3003 - protein, 17 aa, Mus sp.
AVKSKYKASIAALEAKI

SEQ ID NO: 3004 - protein, 18 aa, Mus sp.
GGDTHFDSAEPWTVQNED

SEQ ID NO: 3005 - protein, 17 aa, Mus sp.
EPPPAYEPPAPAPAPLP

SEQ ID NO: 3006 - protein, 15 aa, Mus sp.
VMDAYTSAVSLSATG

SEQ ID NO: 3007 - protein, 15 aa, BOVIN
AVPDAAGPTPSAAGP

SEQ ID NO: 3008 - protein, 18 aa, Mus sp.
GNRITPSYVAFTPEGERL

SEQ ID NO: 3009 - protein, 24 aa, Mus sp.
EAQKSSSIASFKDPKISTSLPVLD

SEQ ID NO: 3010 - protein, 18 aa, Mus sp.
NGKTELNYKNTEPVLDSD

SEQ ID NO: 3011 - protein, 13 aa, Mus sp.
GSPNYAAPEVISG

SEQ ID NO: 3012 - protein, 15 aa, Mus sp.
RLEQPNVVISLSRTE

SEQ ID NO: 3013 - protein, 18 aa, Mus sp.
VTTDHISPAGNIARNSPA

SEQ ID NO: 3014 - protein, 17 aa, Mus sp.
DVVDRVLKSPVASIVYE

SEQ ID NO: 3015 - protein, 14 aa, Mus sp.
NYEYYASHVPESVK

SEQ ID NO: 3016 - protein, 16 aa, Mus sp.
DDIRSDWTNPEINKAV

SEQ ID NO: 3017 - protein, 14 aa, Mus sp.
IASFKDPKISTSLP

SEQ ID NO: 3018 - protein, 19 aa, Mus sp.
VNGKKFTAPHILIATGGVP

SEQ ID NO: 3019 - protein, 16 aa, Mus sp.
DGDSYRSPWSNKYDPP

SEQ ID NO: 3020 - protein, 16 aa, Mus sp.
GPASEWTFSTPEGVPG

SEQ ID NO: 3021 - protein, 16 aa, Mus sp.
EVKAFFESHPAPSAER

SEQ ID NO: 3022 - protein, 17 aa, Mus sp.
TTTVVHAPYPQPQPQPV

SEQ ID NO: 3023 - protein, 13 aa, Mus sp.
IDIFARPTAGFIT

SEQ ID NO: 3024 - protein, 17 aa, Mus sp.
IGFRYVHPLTEEAIEEM

SEQ ID NO: 3025 - protein, 24 aa, Mus sp.
EEKYHEALAKGDVTTQVALQPALK

SEQ ID NO: 3026 - protein, 19 aa, Mus sp.
KGADKTVKGPDGLTALEAT

SEQ ID NO: 3027 - protein, 15 aa, Mus sp.
SQGNLIPARPAPAPP

SEQ ID NO: 3028 - protein, 18 aa, Mus sp.
GNMHYDTPDIRRFDPVPA

SEQ ID NO: 3029 - protein, 16 aa, Mus sp.
VLFVYGGPQVQLVNNS

SEQ ID NO: 3030 - protein, 17 aa, Mus sp.
GIHHWTPPKGHVDPGEN

SEQ ID NO: 3031 - protein, 16 aa, Mus sp.
KPPSYNVATTLPSYDE

SEQ ID NO: 3032 - protein, 17 aa, Mus sp.
FKHAVSDPSILDSLDLN

SEQ ID NO: 3033 - protein, 17 aa, Mus sp.
KGPAFVNPLIPENKEEE

SEQ ID NO: 3034 - protein, 17 aa, Mus sp.
GSVHTYVGGLPEVSVIS

SEQ ID NO: 3035 - protein, 15 aa, Mus sp.
GPGGLWVWGAPAVAQ

SEQ ID NO: 3036 - protein, 15 aa, Mus sp.
LEGDIFIGPKAEEHR

SEQ ID NO: 3037 - protein, 15 aa, Mus sp.
IDWTYRPPSSSRTES

SEQ ID NO: 3038 - protein, 18 aa, Mus sp.
VPDDLLYSFPVVIKNKTW

SEQ ID NO: 3039 - protein, 16 aa, Mus sp.
TAKGLFRAAVPSGAST

SEQ ID NO: 3040 - protein, 15 aa, Mus sp.
YTPYYVAPEVLGPEK

SEQ ID NO: 3041 - protein, 14 aa, Mus sp.
DNYRFAHTNIESLV

SEQ ID NO: 3042 - protein, 18 aa, Mus sp.
KPKGQLPDYTSPVVLPYS

SEQ ID NO: 3043 - protein, 15 aa, Mus sp.
FVHFFAPQGLPVVPK

SEQ ID NO: 3044 - protein, 14 aa, Mus sp.
ISSVTVFYLGQHAM

SEQ ID NO: 3045 - protein, 17 aa, Mus sp.
DPTTAFQAPDVGQALLQ

SEQ ID NO: 3046 - protein, 15 aa, Mus sp.
EDTVTISGPQAAVNE

SEQ ID NO: 3047 - protein, 14 aa, Mus sp.
APTSALGPKASPAP

SEQ ID NO: 3048 - protein, 17 aa, Mus sp.
SARTVITPDPNLSIDQV

SEQ ID NO: 3049 - protein, 17 aa, Mus sp.
KPTVTVVSPLPNDSINP

SEQ ID NO: 3050 - protein, 13 aa, Mus sp.
DYFKGAIPIRKLV

SEQ ID NO: 3051 - protein, 15 aa, Mus sp.
IRGTSYQSPHGIPID

SEQ ID NO: 3052 - protein, 16 aa, Mus sp.
DINAFVGAVSLTAADS

SEQ ID NO: 3053 - protein, 12 aa, Mus sp.
KIVYEGPELNHA

SEQ ID NO: 3054 - protein, 19 aa, Mus sp.
APISSHTAPRPNPTPALPQ

SEQ ID NO: 3055 - protein, 15 aa, Mus sp.
KQIVWNGPVGVFEWE

SEQ ID NO: 3056 - protein, 14 aa, Mus sp.
LDKDSFSDPYAHVS

SEQ ID NO: 3057 - protein, 17 aa, Mus sp.
KPGTTVEYLAPWANQID

SEQ ID NO: 3058 - protein, 13 aa, Mus sp.
SIVYWMTSQPSDA

SEQ ID NO: 3059 - protein, 15 aa, Mus sp.
SDPRWAESVPQEAPG

SEQ ID NO: 3060 - protein, 16 aa, Mus sp.
LRQPYYATRVNAADIE

SEQ ID NO: 3061 - protein, 14 aa, Mus sp.
DHPGNYVEPTIVTG

SEQ ID NO: 3062 - protein, 14 aa, Mus sp.
EGDIFIGPKAEEHR

SEQ ID NO: 3063 - protein, 14 aa, Mus sp.
EQEVLAPQVVLSLG

SEQ ID NO: 3064 - protein, 17 aa, Mus sp.
NPTDEYLDAMMNEAPGP

SEQ ID NO: 3065 - protein, 16 aa, Mus sp.
RMAPYQGPDAAPGALD

SEQ ID NO: 3066 - protein, 17 aa, Mus sp.
FAAEEFKVPAATSAIIT

SEQ ID NO: 3067 - protein, 23 aa, Mus sp.
VPPAGGGDPEAPAPAPAAERPPA

SEQ ID NO: 3068 - protein, 15 aa, Mus sp.
GIFQYQQALANMQLQ

SEQ ID NO: 3069 - protein, 14 aa, Mus sp.
AGPQWADPQISESN

SEQ ID NO: 3070 - protein, 17 aa, Mus sp.
SVPVTKTNLPNPSVDVK

SEQ ID NO: 3071 - protein, 15 aa, Mus sp.
ALVVTTPQAVSIGDV

SEQ ID NO: 3072 - protein, 15 aa, Mus sp.
FGTGHSAPSASPAFG

SEQ ID NO: 3073 - protein, 17 aa, Mus sp.
APAPEFTAAQPEVADWS

SEQ ID NO: 3074 - protein, 22 aa, Mus sp.
KHVPSGIVVKVETGGEPRSAAT

SEQ ID NO: 3075 - protein, 24 aa, Mus sp.
WSFMGALSVVLPCLLCYLPATGCV

SEQ ID NO: 3076 - protein, 16 aa, Mus sp.
EEVEHWFYPQENIIDT

SEQ ID NO: 3077 - protein, 15 aa, Mus sp.
KFTLQDSRTNTAYVG

SEQ ID NO: 3078 - protein, 14 aa, Mus sp.
GDSNFGAPSASVAA

SEQ ID NO: 3079 - protein, 15 aa, Mus sp.
LEMYKVHNPVPLIVG

SEQ ID NO: 3080 - protein, 17 aa, Mus sp.
GTTVYRQFWIFDVQNPD

SEQ ID NO: 3081 - protein, 15 aa, Mus sp.
SVPATFAPSPTPAVV

SEQ ID NO: 3082 - protein, 16 aa, Mus sp.
KERASFITPVPGGVGP

SEQ ID NO: 3083 - protein, 17 aa, Mus sp.
LPNVQVEGPTPNRPRKQ

SEQ ID NO: 3084 - protein, 22 aa, Mus sp.
DGNHTLFHNPHVNPLPTGYEDE

SEQ ID NO: 3085 - protein, 12 aa, Mus sp.
MYLSPLQQAVSD

SEQ ID NO: 3086 - protein, 13 aa, Mus sp.
FPQYTAPSILPSD

SEQ ID NO: 3087 - protein, 15 aa, Mus sp.
NLKHVAGAAAAGAVV

SEQ ID NO: 3088 - protein, 17 aa, Mus sp.
IGVGAYVSPDMMVAEYS

SEQ ID NO: 3089 - protein, 17 aa, Mus sp.
DPSAFAAAAPAAAATTA

SEQ ID NO: 3090 - protein, 16 aa, Mus sp.
EWKDYKAGFGNLEREF

SEQ ID NO: 3091 - protein, 19 aa, Mus sp.
DDERVVGFHVLGPNAGEVT

SEQ ID NO: 3092 - protein, 17 aa, Mus sp.
APPAGSLYSSPVNSSAP

SEQ ID NO: 3093 - protein, 13 aa, Mus sp.
SVGGNMTSMQWAA

SEQ ID NO: 3094 - protein, 16 aa, Mus sp.
LDAYPVENQGLKLGFN

SEQ ID NO: 3095 - protein, 14 aa, Mus sp.
SPYINPIIPFTGPI

SEQ ID NO: 3096 - protein, 16 aa, Mus sp.
DDPIWRGPLPSNGVMH

SEQ ID NO: 3097 - protein, 16 aa, Mus sp.
YDKYFTNPQISQGVPG

SEQ ID NO: 3098 - protein, 18 aa, Mus sp.
GDLERFLSSAAAVSKEHP

SEQ ID NO: 3099 - protein, 18 aa, Mus sp.
LKWKALYTDPKSSETAAF

SEQ ID NO: 3100 - protein, 20 aa, Mus sp.
EPSPVSETVVTPEAAPEKNP

SEQ ID NO: 3101 - protein, 14 aa, Mus sp.
TGMAFRVPTPNVSV

SEQ ID NO: 3102 - protein, 14 aa, Mus sp.
TVIHFNNPKVQASL

SEQ ID NO: 3103 - protein, 14 aa, Mus sp.
IPYQGPSSDYVVVK

SEQ ID NO: 3104 - protein, 15 aa, Mus sp.
APSWHASVPTRAGPD

SEQ ID NO: 3105 - protein, 13 aa, Mus sp.
GIPVYRFVLPANA

SEQ ID NO: 3106 - protein, 20 aa, Mus sp.
GVPVPGSPFPLEAVAPTKPS

SEQ ID NO: 3107 - protein, 16 aa, Mus sp.
SGVEWKGPQVSSSLNL

SEQ ID NO: 3108 - protein, 12 aa, Mus sp.
DLQYAAPGGLIG

SEQ ID NO: 3109 - protein, 15 aa, Mus sp.
IGVGAYVSPDMMVAE

SEQ ID NO: 3110 - protein, 17 aa, Mus sp.
LPETFRRPQIDPAVEGF

SEQ ID NO: 3111 - protein, 26 aa, Mus sp.
EKWEETELDQLFSGPLPGRLPVNHRP

SEQ ID NO: 3112 - protein, 14 aa, Mus sp.
VPWNFHEPQPGQYE

SEQ ID NO: 3113 - protein, 18 aa, Mus sp.
AQRAGYKAAIVHNVDSDD

SEQ ID NO: 3114 - protein, 15 aa, Mus sp.
TPDYIAPEIIAYQPY

SEQ ID NO: 3115 - protein, 14 aa, Mus sp.
YALVYTSPVIPELK

SEQ ID NO: 3116 - protein, 17 aa, Mus sp.
LLGNMWAQTWSNIYDLV

SEQ ID NO: 3117 - protein, 14 aa, Mus sp.
ASPELTSPLANQSL

SEQ ID NO: 3118 - protein, 14 aa, Mus sp.
SVGAWTGPMGNWAM

SEQ ID NO: 3119 - protein, 16 aa, Mus sp.
VTYEWAPPVQNQALAR

SEQ ID NO: 3120 - protein, 19 aa, Mus sp.
KPGTTVEYLAPWANQIDMA

SEQ ID NO: 3121 - protein, 16 aa, Listeria monocytogenes
GTKEKVVATPVSNVST

SEQ ID NO: 3122 - protein, 14 aa, Mus sp.
LSRFTSGVPSFVLD

SEQ ID NO: 3123 - protein, 16 aa, Mus sp.
YNPAQQILAYTGLCPP

SEQ ID NO: 3124 - protein, 24 aa, Mus sp.
SPAPSTRVITNQYNSPTGLYSSEN

SEQ ID NO: 3125 - protein, 17 aa, Mus sp.
GPGLDFEGPDAKLSGPN

SEQ ID NO: 3126 - protein, 15 aa, Mus sp.
TKRYMAPEVLDDSIN

SEQ ID NO: 3127 - protein, 13 aa, Mus sp.
GERFEAPEALFQP

SEQ ID NO: 3128 - protein, 15 aa, Mus sp.
APPHFHFGQTNRTPE

SEQ ID NO: 3129 - protein, 21 aa, Mus sp.
EPSKLKRSYSSPDITQALQEE

SEQ ID NO: 3130 - protein, 18 aa, Mus sp.
GPASEWTFSTPEGVPGHP

SEQ ID NO: 3131 - protein, 15 aa, Mus sp.
APMYYRGAQAAIVVY

SEQ ID NO: 3132 - protein, 20 aa, Mus sp.
QLQPQPATLLGKAGAFPPPA

SEQ ID NO: 3133 - protein, 16 aa, Mus sp.
FVAWATGEPNFANDDE

SEQ ID NO: 3134 - protein, 12 aa, Mus sp.
EDRRYNPPIIHQ

SEQ ID NO: 3135 - protein, 26 aa, Mus sp.
DYKDESGFPKPPSYNVATTLPSYDEA

SEQ ID NO: 3136 - protein, 19 aa, Mus sp.
DPAGPNFEYAEAPSRLSPD

SEQ ID NO: 3137 - protein, 20 aa, Mus sp.
KNPTDAYLDAMMNEAPGPIN

SEQ ID NO: 3138 - protein, 17 aa, Mus sp.
ITGVDFIGSTVGLAKVS

SEQ ID NO: 3139 - protein, 16 aa, Mus sp.
EDKVYWTDVINEAIFS

SEQ ID NO: 3140 - protein, 16 aa, Mus sp.
GDGIEDFVSGVPRAAR

SEQ ID NO: 3141 - protein, 16 aa, Mus sp.
KRSNEFDYPSVGQLAH

SEQ ID NO: 3142 - protein, 18 aa, Mus sp.
FNNQAYHSPATALAIVDN

SEQ ID NO: 3143 - protein, 17 aa, Mus sp.
FRLWDFRDPSIHSVNVF

SEQ ID NO: 3144 - protein, 15 aa, Mus sp.
LSLKYHFVTPLTSMV

SEQ ID NO: 3145 - protein, 15 aa, Mus sp.
IARQNFTEPTAIQAQ

SEQ ID NO: 3146 - protein, 17 aa, Mus sp.
APNLHFHNPNPEIPALL

SEQ ID NO: 3147 - protein, 19 aa, Mus sp.
DPAVADLVKNPTASLVLPE

SEQ ID NO: 3148 - protein, 15 aa, Mus sp.
EDYVELPPSVSQAAT

SEQ ID NO: 3149 - protein, 15 aa, Mus sp.
LVQTYVGAISNGSLP

SEQ ID NO: 3150 - protein, 15 aa, Mus sp.
APAPEFTAAQPEVAD

SEQ ID NO: 3151 - protein, 16 aa, Mus sp.
INDYKGAVIVVSHDAR

SEQ ID NO: 3152 - protein, 17 aa, Mus sp.
TSNDVHMYLPTKLFQPS

SEQ ID NO: 3153 - protein, 17 aa, Mus sp.
LEMYKVHNPVPLIVGSS

SEQ ID NO: 3154 - protein, 15 aa, Mus sp.
SGVEWKGPQVSSSLN

SEQ ID NO: 3155 - protein, 13 aa, Mus sp.
RVPTPNVSVVDLT

SEQ ID NO: 3156 - protein, 13 aa, Mus sp.
GPPIFNPVANEVY

SEQ ID NO: 3157 - protein, 16 aa, Mus sp.
AGMAVFTPVINGVGGN

SEQ ID NO: 3158 - protein, 14 aa, Mus sp.
DSYRSPWSNKYDPP

SEQ ID NO: 3159 - protein, 15 aa, Mus sp.
EEEYYAEPGVTEAEP

SEQ ID NO: 3160 - protein, 21 aa, Mus sp.
EKPVPAAPVPSPVAPAPVPSR

SEQ ID NO: 3161 - protein, 16 aa, Mus sp.
MAFRVPTPNVSVVDLT

SEQ ID NO: 3162 - protein, 16 aa, Mus sp.
AVPPVFTQPTANIMPS

SEQ ID NO: 3163 - protein, 15 aa, Mus sp.
LNLAYIGAVPHSGIE

SEQ ID NO: 3164 - protein, 17 aa, Mus sp.
VGPVPWLGPQTDEAIKG

SEQ ID NO: 3165 - protein, 19 aa, Mus sp.
FEDYVELPPSVSQAATSPP

SEQ ID NO: 3166 - protein, 15 aa, Mus sp.
LAWVAFPLALVSGTV

SEQ ID NO: 3167 - protein, 15 aa, Mus sp.
TIRYMAPEVLEGAVN

SEQ ID NO: 3168 - protein, 15 aa, Mus sp.
PLNSVFVAPAVTPVK

SEQ ID NO: 3169 - protein, 12 aa, Mus sp.
NSEFDPPGPNVA

SEQ ID NO: 3170 - protein, 17 aa, Mus sp.
GIYEYYEPRLSVLPSPV

SEQ ID NO: 3171 - protein, 19 aa, Mus sp.
MDEATRYLAPTILTDVDPN

SEQ ID NO: 3172 - protein, 15 aa, Mus sp.
DSSKNVFLSPMSISS

SEQ ID NO: 3173 - protein, 18 aa, Mus sp.
EPPPAYEPPAPAPAPLPP

SEQ ID NO: 3174 - protein, 14 aa, Mus sp.
SVFVAPAVTPVKGV

SEQ ID NO: 3175 - protein, 15 aa, Mus sp.
KRLEFEASQVLGTMD

SEQ ID NO: 3176 - protein, 16 aa, Mus sp.
YTIPFYTPIPNGLYPS

SEQ ID NO: 3177 - protein, 14 aa, Mus sp.
LSLKYHFVTPLTSM

SEQ ID NO: 3178 - protein, 15 aa, Mus sp.
WKALYTDPKSSETAA

SEQ ID NO: 3179 - protein, 16 aa, Mus sp.
KADDIVGPVTHEIFEN

SEQ ID NO: 3180 - protein, 12 aa, Mus sp.
ALPYDTPVPGYM

SEQ ID NO: 3181 - protein, 17 aa, Mus sp.
FKQETLPSNSNESHDHM

SEQ ID NO: 3182 - protein, 15 aa, Mus sp.
RDKWLAPDGLIFPDR

SEQ ID NO: 3183 - protein, 18 aa, Mus sp.
GTTVYRQFWIFDVQNPDD

SEQ ID NO: 3184 - protein, 16 aa, Mus sp.
ANPDFTQPISEVVDEV

SEQ ID NO: 3185 - protein, 15 aa, Mus sp.
DTRFVAPGALGNAPW

SEQ ID NO: 3186 - protein, 17 aa, Mus sp.
LQKTQYISPNLNPNDVT

SEQ ID NO: 3187 - protein, 18 aa, Mus sp.
NLRDNYRFAHTNIESLVK

SEQ ID NO: 3188 - protein, 14 aa, Mus sp.
ASPVFRAPGLTAVA

SEQ ID NO: 3189 - protein, 12 aa, Mus sp.
APDTRFVAPGAL

SEQ ID NO: 3190 - protein, 16 aa, Mus sp.
VLRIINEPTAAAIAYG

SEQ ID NO: 3191 - protein, 17 aa, Mus sp.
IDLKGIPVYRFVLPANA

SEQ ID NO: 3192 - protein, 17 aa, Mus sp.
EDRRYNPPIIHQGFQDT

SEQ ID NO: 3193 - protein, 17 aa, Mus sp.
KPVPAAPVPSPVAPAPV

SEQ ID NO: 3194 - protein, 15 aa, Mus sp.
EIQDWSASSPHSAAY

SEQ ID NO: 3195 - protein, 16 aa, Mus sp.
EKYVTSAPMPEPGAPG

SEQ ID NO: 3196 - protein, 16 aa, Mus sp.
NPPSYYTQPVPVPNAN

SEQ ID NO: 3197 - protein, 14 aa, Mus sp.
DFYGSPIPSVSLKL

SEQ ID NO: 3198 - protein, 17 aa, Mus sp.
YGIPFAAPTALASRDGN

SEQ ID NO: 3199 - protein, 14 aa, Mus sp.
EMYKVHNPVPLIVG

SEQ ID NO: 3200 - protein, 18 aa, Mus sp.
EDITHTYKYPEGSPEERE

SEQ ID NO: 3201 - protein, 17 aa, Mus sp.
IDDVIYHEAAVRQAGAE

SEQ ID NO: 3202 - protein, 21 aa, BOVIN
SVVVGPSVVAVPLPLHRAHYD

SEQ ID NO: 3203 - protein, 15 aa, Mus sp.
VDFDIAGPSIRGALV

SEQ ID NO: 3204 - protein, 19 aa, Mus sp.
GPEVDVSLPKANIDVSGPK

SEQ ID NO: 3205 - protein, 16 aa, Mus sp.
GNLDYWTYPGSLTTPP

SEQ ID NO: 3206 - protein, 17 aa, Mus sp.
SPDDPSRYITPDQLADL

SEQ ID NO: 3207 - protein, 26 aa, Mus sp.
GEGGEATEQPGLNGAAAAAAAEAPDE

SEQ ID NO: 3208 - protein, 16 aa, Mus sp.
LLAETVAPAVRGANPH

SEQ ID NO: 3209 - protein, 15 aa, Mus sp.
RERYNFPNPNPFVED

SEQ ID NO: 3210 - protein, 16 aa, Mus sp.
LYPDTAGPEAALEAED

SEQ ID NO: 3211 - protein, 16 aa, Mus sp.
VVLYHRSPTANENQNL

SEQ ID NO: 3212 - protein, 15 aa, Mus sp.
SRGEYSWAVAQGVKQ

SEQ ID NO: 3213 - protein, 13 aa, Mus sp.
IASFKDPKISTSL

SEQ ID NO: 3214 - protein, 21 aa, Mus sp.
SEIDLKGIPVYRFVLPANAFA

SEQ ID NO: 3215 - protein, 13 aa, Mus sp.
FRVPTPNVSVVDL

SEQ ID NO: 3216 - protein, 21 aa, Mus sp.
YPNPTLDHYKEPSAIFQLPYE

SEQ ID NO: 3217 - protein, 29 aa, Mus sp.
KKVNRITGLDPAGPNFEYAEAPSRLSPDD

SEQ ID NO: 3218 - protein, 15 aa, Mus sp.
SFFWNVAPGAESAVA

SEQ ID NO: 3219 - protein, 15 aa, Mus sp.
YPTAYPAAAPAYNPS

SEQ ID NO: 3220 - protein, 16 aa, Mus sp.
VTVVSPLPNDSINPQP

SEQ ID NO: 3221 - protein, 14 aa, Mus sp.
VDPYNNPVPRGLEA

SEQ ID NO: 3222 - protein, 15 aa, Mus sp.
GSFVYKGGKIYKVPS

SEQ ID NO: 3223 - protein, 15 aa, Mus sp.
YIEGYVPSQADVAVF

SEQ ID NO: 3224 - protein, 27 aa, Mus sp.
LSPDDADFVDVLHTFTRGSPGRSIGIQ

SEQ ID NO: 3225 - protein, 15 aa, Mus sp.
ITYSYAGARAPMGQG

SEQ ID NO: 3226 - protein, 15 aa, Mus sp.
DGNFVEATALHTAPH

SEQ ID NO: 3227 - protein, 16 aa, Mus sp.
EFDYSGSQAIKALKEE

SEQ ID NO: 3228 - protein, 15 aa, Mus sp.
LVKDGYQMAQPVFAP

SEQ ID NO: 3229 - protein, 16 aa, Mus sp.
YTLWKEFFFSVPAGPP

SEQ ID NO: 3230 - protein, 16 aa, Mus sp.
SEWKFTITPPSAQVVG

SEQ ID NO: 3231 - protein, 17 aa, Mus sp.
DSPDVVYSPETIEARYE

SEQ ID NO: 3232 - protein, 16 aa, Mus sp.
VFPEFAAAHSNLASVL

SEQ ID NO: 3233 - protein, 12 aa, Mus sp.
LPYDTPVPGYMN

SEQ ID NO: 3234 - protein, 17 aa, Mus sp.
GGLPDYSAPNPIKVTHR

SEQ ID NO: 3235 - protein, 15 aa, Mus sp.
GGVYASPSIAGSRPG

SEQ ID NO: 3236 - protein, 13 aa, Mus sp.
GTPDYIAPEILQG

SEQ ID NO: 3237 - protein, 17 aa, Mus sp.
EPTTLFKTASALRSSAP

SEQ ID NO: 3238 - protein, 17 aa, Mus sp.
KPNGIFKGPTAENAEYL

SEQ ID NO: 3239 - protein, 23 aa, Mus sp.
PGIDGIPGEKGNAGDIGGPGPPG

SEQ ID NO: 3240 - protein, 17 aa, Mus sp.
FPKPPSYNVATTLPSYD

SEQ ID NO: 3241 - protein, 18 aa, Mus sp.
EPTSSSPYNPPDLEEAAK

SEQ ID NO: 3242 - protein, 17 aa, Mus sp.
RPALAYESVVAQEGNPI

SEQ ID NO: 3243 - protein, 16 aa, Mus sp.
ELDQLFSGPLPGRLPV

SEQ ID NO: 3244 - protein, 17 aa, Mus sp.
FPPEFYEHAKALWEDEG

SEQ ID NO: 3245 - protein, 15 aa, Mus sp.
VPPVFTQPTANIMPS

SEQ ID NO: 3246 - protein, 16 aa, Mus sp.
GIDPYDQPNAIYIERH

SEQ ID NO: 3247 - protein, 27 aa, Mus sp.
IPISKVKDVYVITDQIPVFVTMSQKND

SEQ ID NO: 3248 - protein, 14 aa, Mus sp.
ANPDFTQPISEVVD

SEQ ID NO: 3249 - protein, 13 aa, Mus sp.
TVIHFNNPKVQAS

SEQ ID NO: 3250 - protein, 15 aa, Mus sp.
GTPEFLAPEVLTDTS

SEQ ID NO: 3251 - protein, 15 aa, Mus sp.
EEEVEVFLPKFKLEE

SEQ ID NO: 3252 - protein, 18 aa, Mus sp.
SREQFSYVLPTVHSLEPS

SEQ ID NO: 3253 - protein, 20 aa, Mus sp.
SDDVLANMISEPRISYGNDA

SEQ ID NO: 3254 - protein, 17 aa, Mus sp.
SPPPYAAYATPTPEVYG

SEQ ID NO: 3255 - protein, 17 aa, Mus sp.
NVMRIINEPTAAAIAYG

SEQ ID NO: 3256 - protein, 17 aa, Mus sp.
TPRVLSQAPSPLYSVEF

SEQ ID NO: 3257 - protein, 20 aa, Mus sp.
KLTGMAFRVPTPNVSVVDLT

SEQ ID NO: 3258 - protein, 15 aa, Mus sp.
YALVYTSPVIPELKL

SEQ ID NO: 3259 - protein, 16 aa, Mus sp.
DVPEWFRGSRLNYAEN

SEQ ID NO: 3260 - protein, 15 aa, Mus sp.
GDLSQHATPLPTPAV

SEQ ID NO: 3261 - protein, 13 aa, Mus sp.
ITDKFWGPSGAES

SEQ ID NO: 3262 - protein, 15 aa, Mus sp.
WSDAAAPFAGLSTDQ

SEQ ID NO: 3263 - protein, 16 aa, Mus sp.
LPSTSYLPSTPSVVPA

SEQ ID NO: 3264 - protein, 14 aa, Mus sp.
GKKFTAPHILIATG

SEQ ID NO: 3265 - protein, 15 aa, Mus sp.
IPKLVYHKNIPEWDH

SEQ ID NO: 3266 - protein, 16 aa, Mus sp.
VSTLIWAAPRLQSEVA

SEQ ID NO: 3267 - protein, 24 aa, Mus sp.
KPTVTVVSPLPNDSINPQPSPDGL

SEQ ID NO: 3268 - protein, 16 aa, Mus sp.
RPYLNWNGPPASLEEA

SEQ ID NO: 3269 - protein, 12 aa, Mus sp.
KPFQNPVPNQSP

SEQ ID NO: 3270 - protein, 14 aa, Mus sp.
KFDEWVAPTPEVAD

SEQ ID NO: 3271 - protein, 15 aa, Mus sp.
GYPTAYPAAAPAYNP

SEQ ID NO: 3272 - protein, 18 aa, Mus sp.
GEQIYYAGPVNNPGLDVP

SEQ ID NO: 3273 - protein, 14 aa, Mus sp.
FPIKWTAPEAINFG

SEQ ID NO: 3274 - protein, 15 aa, Mus sp.
TVTPWKAPIVWEGTY

SEQ ID NO: 3275 - protein, 16 aa, Mus sp.
APDAWDYSQGFVNEEM

SEQ ID NO: 3276 - protein, 13 aa, Mus sp.
RYNPPIIHQGFQD

SEQ ID NO: 3277 - protein, 15 aa, Mus sp.
YPNSFSAPEQQRSAL

SEQ ID NO: 3278 - protein, 15 aa, Mus sp.
TKVVFLSPAVPEEPE

SEQ ID NO: 3279 - protein, 16 aa, Mus sp.
EYQQYQDATAEEEGEF

SEQ ID NO: 3280 - protein, 15 aa, Mus sp.
LFEDNMALPSESVSS

SEQ ID NO: 3281 - protein, 17 aa, Mus sp.
STQLIRNGDWTFQVLVM

SEQ ID NO: 3282 - protein, 17 aa, Mus sp.
HNLFEDNMALPSESVSS

SEQ ID NO: 3283 - protein, 16 aa, Mus sp.
DPDGFSWPATLPSVYK

SEQ ID NO: 3284 - protein, 17 aa, Mus sp.
EAIETIVAAMSNLVPPV

SEQ ID NO: 3285 - protein, 21 aa, Mus sp.
GQDHVDFSQPEPHTVLFHEPG

SEQ ID NO: 3286 - protein, 15 aa, Mus sp.
ADDIVGPVTHEIFEN

SEQ ID NO: 3287 - protein, 23 aa, Mus sp.
DEDLETKKFRFEEPVVLPDLSDQ

SEQ ID NO: 3288 - protein, 14 aa, Mus sp.
AQTAYSANPASQAF

SEQ ID NO: 3289 - protein, 24 aa, Mus sp.
LPNKPTVTVVSPLPNDSINPQPSP

SEQ ID NO: 3290 - protein, 17 aa, Mus sp.
VPPSVSPSPATAFSGPP

SEQ ID NO: 3291 - protein, 17 aa, Mus sp.
EPYLEPRSPEARGVEAP

SEQ ID NO: 3292 - protein, 17 aa, Mus sp.
LTVTPWKAPIVWEGTYD

SEQ ID NO: 3293 - protein, 18 aa, Mus sp.
VPDFSDYRRAEVLDSTKS

SEQ ID NO: 3294 - protein, 19 aa, Mus sp.
APGPSHTVAAPQAAAAAAL

SEQ ID NO: 3295 - protein, 18 aa, Mus sp.
IFSPYFINGQQLHLSEDM

SEQ ID NO: 3296 - protein, 15 aa, Mus sp.
LPFGAYTNPFATPAQ

SEQ ID NO: 3297 - protein, 17 aa, Mus sp.
YPNTPYISPVASYSGQP

SEQ ID NO: 3298 - protein, 15 aa, Mus sp.
TPERLNSPVTIPAVM

SEQ ID NO: 3299 - protein, 14 aa, Mus sp.
KPVPAAPVPSPVAP

SEQ ID NO: 3300 - protein, 14 aa, Mus sp.
VPIYEGYALPHAIL

SEQ ID NO: 3301 - protein, 16 aa, Mus sp.
YKRSNEFDYPSVGQLA

SEQ ID NO: 3302 - protein, 17 aa, Mus sp.
IQEMEKEDRRYNPPIIH

SEQ ID NO: 3303 - protein, 12 aa, Mus sp.
RDYVPPTANLDQ

SEQ ID NO: 3304 - protein, 14 aa, Mus sp.
VRVDEYDYSKPIQG

SEQ ID NO: 3305 - protein, 18 aa, Mus sp.
IGRTWNDPSVQQDIKFLP

SEQ ID NO: 3306 - protein, 16 aa, Mus sp.
VELPPSVSQAATSPPG

SEQ ID NO: 3307 - protein, 13 aa, Mus sp.
NDLQYAAPGGLIG

SEQ ID NO: 3308 - protein, 16 aa, Mus sp.
EMYKVHNPVPLIVGSS

SEQ ID NO: 3309 - protein, 13 aa, Mus sp.
LVEYEASAAGLIR

SEQ ID NO: 3310 - protein, 12 aa, Mus sp.
YEWAPPVQNQAL

SEQ ID NO: 3311 - protein, 15 aa, Mus sp.
LDNYDAPDIANIAIS

SEQ ID NO: 3312 - protein, 17 aa, Mus sp.
LPPHVYSTPQPSLPPVQ

SEQ ID NO: 3313 - protein, 15 aa, Mus sp.
GTPDYIAPEILQGLK

SEQ ID NO: 3314 - protein, 14 aa, Mus sp.
DVYKYETSGIGEAR

SEQ ID NO: 3315 - protein, 20 aa, Mus sp.
MEKEDRRYNPPIIHQGFQDT

SEQ ID NO: 3316 - protein, 8 aa, Mus sp.
SALIYSNL

SEQ ID NO: 3317 - protein, 16 aa, Mus sp.
LANMISEPRISYGNDA

SEQ ID NO: 3318 - protein, 16 aa, Mus sp.
IPEQSFYTKPLPGIIM

SEQ ID NO: 3319 - protein, 20 aa, Mus sp.
DKSYIEGYVPSQADVAVFEA

SEQ ID NO: 3320 - protein, 17 aa, Mus sp.
LLPEYANAEIVRTRDPE

SEQ ID NO: 3321 - protein, 15 aa, Mus sp.
EPYMYLSPLQQAVSD

SEQ ID NO: 3322 - protein, 16 aa, Mus sp.
IPPTHYAASRAASVAE

SEQ ID NO: 3323 - protein, 14 aa, Mus sp.
WKFTITPPSAQVVG

SEQ ID NO: 3324 - protein, 17 aa, Mus sp.
GVPDDLLYSFPVVIKNK

SEQ ID NO: 3325 - protein, 14 aa, Mus sp.
EVSSVEAPSVSPAR

SEQ ID NO: 3326 - protein, 30 aa, Mus sp.
ETTVNPSGKNVSYNISSTVRVVLNSMDVHS

SEQ ID NO: 3327 - protein, 16 aa, Mus sp.
SAFSYVDPVITSISPR

SEQ ID NO: 3328 - protein, 15 aa, Mus sp.
APNLHFHNPNPEIPA

SEQ ID NO: 3329 - protein, 15 aa, Mus sp.
EQIYYAGPVNNPGLD

SEQ ID NO: 3330 - protein, 17 aa, Mus sp.
MYQMYGGPVVLVAHSMG

SEQ ID NO: 3331 - protein, 15 aa, Mus sp.
AVKSKYKASIAALEA

SEQ ID NO: 3332 - protein, 15 aa, Mus sp.
GIHHWTPPKGHVDPG

SEQ ID NO: 3333 - protein, 15 aa, Mus sp.
YPNQVYYRPVDQYSN

SEQ ID NO: 3334 - protein, 15 aa, Mus sp.
NNIPYFETSAKEAIN

SEQ ID NO: 3335 - protein, 15 aa, Mus sp.
VNSQYQEPDIIIHFA

SEQ ID NO: 3336 - protein, 11 aa, Mus sp.
GAWTGPMGNWA

SEQ ID NO: 3337 - protein, 16 aa, Mus sp.
RSQVTPSVPSEALDDS

SEQ ID NO: 3338 - protein, 19 aa, Mus sp.
DGELTYENVQVSPVPGGPP

SEQ ID NO: 3339 - protein, 11 aa, Mus sp.
TPWKAPIVWEG

SEQ ID NO: 3340 - protein, 24 aa, Mus sp.
GQDGEQAPPLPIKTPIPTPSTLPA

SEQ ID NO: 3341 - protein, 16 aa, Mus sp.
LPAAAQAPDALPAGWE

SEQ ID NO: 3342 - protein, 9 aa, Mus sp.
IPFYTPIPN

SEQ ID NO: 3343 - protein, 20 aa, Mus sp.
NGKLTGMAFRVPTPNVSVVD

SEQ ID NO: 3344 - protein, 17 aa, Mus sp.
GRERYNFPNPNPFVEDD

SEQ ID NO: 3345 - protein, 18 aa, Mus sp.
GPGGKWMIPPEAKESMDK

SEQ ID NO: 3346 - protein, 12 aa, Mus sp.
LKYHFVTPLTSM

SEQ ID NO: 3347 - protein, 25 aa, Mus sp.
APAPAAPAAAEPQAEAPAAAASSEQ

SEQ ID NO: 3348 - protein, 14 aa, Mus sp.
RDYVPPTANLDQKD

SEQ ID NO: 3349 - protein, 15 aa, Mus sp.
QLEALVGPEANVGPY

SEQ ID NO: 3350 - protein, 12 aa, Mus sp.
YLPYKSPGINVD

SEQ ID NO: 3351 - protein, 18 aa, Mus sp.
EEKPVPAAPVPSPVAPAP

SEQ ID NO: 3352 - protein, 16 aa, Mus sp.
RPVQFPYVTPAPHEPV

SEQ ID NO: 3353 - protein, 14 aa, Mus sp.
VDLPNYSSPNALVL

SEQ ID NO: 3354 - protein, 22 aa, Mus sp.
GGDPEAPAPAPAAERPPAPGPG

SEQ ID NO: 3355 - protein, 13 aa, Mus sp.
APMYYRGAQAAIV

SEQ ID NO: 3356 - protein, 16 aa, Mus sp.
REGSYEAAKILLDHFA

SEQ ID NO: 3357 - protein, 14 aa, Mus sp.
VDFDFAGPAIHGSA

SEQ ID NO: 3358 - protein, 14 aa, Mus sp.
LPAAAQAPDALPAG

SEQ ID NO: 3359 - protein, 14 aa, Mus sp.
KVELVPPTPAEIPT

SEQ ID NO: 3360 - protein, 17 aa, Mus sp.
GDTIEFRGPNGLLVYQG

SEQ ID NO: 3361 - protein, 19 aa, Mus sp.
TPSPESPDQWSSSSPHSAS

SEQ ID NO: 3362 - protein, 17 aa, Mus sp.
SAPPHFHFGQTNRTPEF

SEQ ID NO: 3363 - protein, 14 aa, Mus sp.
EDYVELPPSVSQAA

SEQ ID NO: 3364 - protein, 15 aa, Mus sp.
EDAIQFATGMANALE

SEQ ID NO: 3365 - protein, 14 aa, Mus sp.
RQTTQYPEANALVR

SEQ ID NO: 3366 - protein, 16 aa, Mus sp.
GTIRYMAPEVLEGAVN

SEQ ID NO: 3367 - protein, 16 aa, Mus sp.
SNLLLQSPGVLTAARE

SEQ ID NO: 3368 - protein, 17 aa, Mus sp.
DLSQHATPLPTPAVLPG

SEQ ID NO: 3369 - protein, 19 aa, Mus sp.
VGEVKDYEPPFGSKVREHP

SEQ ID NO: 3370 - protein, 14 aa, Mus sp.
VTPWKAPIVWEGTY

SEQ ID NO: 3371 - protein, 16 aa, Mus sp.
AQTAYSANPASQAFVL

SEQ ID NO: 3372 - protein, 15 aa, Mus sp.
EEDTEYMTPTSRPVG

SEQ ID NO: 3373 - protein, 12 aa, Mus sp.
WKYEKPDGSPVF

SEQ ID NO: 3374 - protein, 16 aa, Mus sp.
NDLQYAAPGGLIGVGT

SEQ ID NO: 3375 - protein, 12 aa, Mus sp.
EQEVLAPQVVLS

SEQ ID NO: 3376 - protein, 13 aa, Mus sp.
IDPYDQPNAIYIE

SEQ ID NO: 3377 - protein, 16 aa, Mus sp.
TPTFTYKAAHIFFTDT

SEQ ID NO: 3378 - protein, 20 aa, Mus sp.
DGDLERFLSSAAAVSKEHPV

SEQ ID NO: 3379 - protein, 20 aa, Mus sp.
LPDLTNIHFPSPLPTPLDPE

SEQ ID NO: 3380 - protein, 16 aa, Mus sp.
TEDDYNEPTVHFAEDT

SEQ ID NO: 3381 - protein, 15 aa, Mus sp.
PGKTSRLYQTFYLNT

SEQ ID NO: 3382 - protein, 15 aa, Mus sp.
EEAFHPREMKAEDED

SEQ ID NO: 3383 - protein, 15 aa, Mus sp.
KGFYKEATQLWGKAE

SEQ ID NO: 3384 - protein, 17 aa, Mus sp.
IEQFVYSSPHDNKSWEM

SEQ ID NO: 3385 - protein, 16 aa, Mus sp.
KAVDVFFPPEAQNDFP

SEQ ID NO: 3386 - protein, 15 aa, Mus sp.
ASVATNPIITPVAQE

SEQ ID NO: 3387 - protein, 14 aa, Mus sp.
DYVPPTANLDQKDK

SEQ ID NO: 3388 - protein, 15 aa, Mus sp.
GPGSAVSPYPSFNVS

SEQ ID NO: 3389 - protein, 16 aa, Mus sp.
SFPKFKGSLALRTLDL

SEQ ID NO: 3390 - protein, 25 aa, Mus sp.
LPDGRIIKVGGERFEAPEALFQPHL

SEQ ID NO: 3391 - protein, 18 aa, Mus sp.
IEVDQIYHLASPASPPNY

SEQ ID NO: 3392 - protein, 15 aa, Mus sp.
DRKIVYEGPELNHAF

SEQ ID NO: 3393 - protein, 17 aa, Mus sp.
EWKFTITPPSAQVVGVL

SEQ ID NO: 3394 - protein, 14 aa, Mus sp.
VQWNDPGAQYSLVN

SEQ ID NO: 3395 - protein, 18 aa, Mus sp.
IDNSKEFEFIESQTSSHR

SEQ ID NO: 3396 - protein, 19 aa, Mus sp.
IPSPSSAFTPAHAATSSHA

SEQ ID NO: 3397 - protein, 18 aa, Mus sp.
EKPVPAAPVPSPVAPAPV

SEQ ID NO: 3398 - protein, 21 aa, Mus sp.
NGKLTGMAFRVPTPNVSVVDL

SEQ ID NO: 3399 - protein, 15 aa, Mus sp.
LSEGFSSPSSLMSPS

SEQ ID NO: 3400 - protein, 18 aa, Mus sp.
VNKGFYKEATQLWGKAEM

SEQ ID NO: 3401 - protein, 18 aa, Mus sp.
FPKPPSYNVATTLPSYDE

SEQ ID NO: 3402 - protein, 16 aa, Mus sp.
GTPDYIAPEILQGLKY

SEQ ID NO: 3403 - protein, 16 aa, Mus sp.
APPHFHFGQTNRTPEF

SEQ ID NO: 3404 - protein, 12 aa, Mus sp.
IEVAPPKAHEVR

SEQ ID NO: 3405 - protein, 16 aa, Mus sp.
GVDFIGSTVGLAKVSA

SEQ ID NO: 3406 - protein, 13 aa, Mus sp.
TPEYLAPEVLEDN

SEQ ID NO: 3407 - protein, 17 aa, Mus sp.
GMAFRVPTPNVSVVDLT

SEQ ID NO: 3408 - protein, 16 aa, Mus sp.
MQLTYLPPSPVLAEST

SEQ ID NO: 3409 - protein, 14 aa, Mus sp.
TARYMAPEVLESRM

SEQ ID NO: 3410 - protein, 12 aa, Mus sp.
TENGYSYPVVSY

SEQ ID NO: 3411 - protein, 15 aa, Mus sp.
AFDTRAPMAAQGMVE

SEQ ID NO: 3412 - protein, 15 aa, Mus sp.
GTPEYLAPEVIQSKG

SEQ ID NO: 3413 - protein, 18 aa, Mus sp.
GTVIHFNNPKVQASLAAN

SEQ ID NO: 3414 - protein, 15 aa, Mus sp.
GALLLNAPVVSITQG

SEQ ID NO: 3415 - protein, 15 aa, Mus sp.
ATFGVSGGHINPAVS

SEQ ID NO: 3416 - protein, 17 aa, Mus sp.
APAAATSAPAPAPAPAP

SEQ ID NO: 3417 - protein, 11 aa, Mus sp.
VATSIHEAVTK

SEQ ID NO: 3418 - protein, 13 aa, Mus sp.
SVGAWTGPMGNWA

SEQ ID NO: 3419 - protein, 15 aa, Mus sp.
DSQYRASAPNSHVPL

SEQ ID NO: 3420 - protein, 21 aa, Mus sp.
DDREDITHTYKYPEGSPEERE

SEQ ID NO: 3421 - protein, 17 aa, Mus sp.
NPGDGAFYGPKIDIQIK

SEQ ID NO: 3422 - protein, 15 aa, Mus sp.
EPPPAYEPPAPAPAP

SEQ ID NO: 3423 - protein, 14 aa, Mus sp.
FPYEGPAPLEAIAN

SEQ ID NO: 3424 - protein, 18 aa, Mus sp.
DEGERYIAPTVLVDVQET

SEQ ID NO: 3425 - protein, 15 aa, Mus sp.
GIDPYDQPNAIYIER

SEQ ID NO: 3426 - protein, 17 aa, Mus sp.
TVIHFNNPKVQASLAAN

SEQ ID NO: 3427 - protein, 17 aa, Mus sp.
GGYKPFQNPVPNQSPSS

SEQ ID NO: 3428 - protein, 17 aa, Mus sp.
RVKQYYEVPIAMKSVFD

SEQ ID NO: 3429 - protein, 17 aa, Mus sp.
VAPKETTIWVSPSPILE

SEQ ID NO: 3430 - protein, 14 aa, Mus sp.
DLSQHATPLPTPAV

SEQ ID NO: 3431 - protein, 15 aa, Mus sp.
VEALEQPAPAIVSAL

SEQ ID NO: 3432 - protein, 18 aa, Mus sp.
IDFEDVIAEPEGTHSFDG

SEQ ID NO: 3433 - protein, 17 aa, Mus sp.
SPTGNIFFSPFSISSAL

SEQ ID NO: 3434 - protein, 15 aa, Mus sp.
ITDKFWGPSGAESVI

SEQ ID NO: 3435 - protein, 11 aa, Mus sp.
RYMAPEVLDET

SEQ ID NO: 3436 - protein, 16 aa, Mus sp.
IPITYPTTAPEIAVPE

SEQ ID NO: 3437 - protein, 13 aa, Mus sp.
RYMAPEVLEGAIN

SEQ ID NO: 3438 - protein, 15 aa, Mus sp.
LRLQVESPQVHWEPT

SEQ ID NO: 3439 - protein, 16 aa, Mus sp.
KLGMLTIGVDLQGVLM

SEQ ID NO: 3440 - protein, 17 aa, Mus sp.
EVKDYEPPFGSKVREHP

SEQ ID NO: 3441 - protein, 17 aa, Mus sp.
TTVSLSAPDALKIITEN

SEQ ID NO: 3442 - protein, 15 aa, Mus sp.
VLVLDFVTPTPLGTR

SEQ ID NO: 3443 - protein, 11 aa, Mus sp.
SDWTNPEINKA

SEQ ID NO: 3444 - protein, 14 aa, Mus sp.
LEALVGPEANVGPY

SEQ ID NO: 3445 - protein, 18 aa, Mus sp.
LPPHVYSTPQPSLPPVQP

SEQ ID NO: 3446 - protein, 22 aa, Mus sp.
IQEMEKEDRRYNPPIIHQGFQD

SEQ ID NO: 3447 - protein, 16 aa, Mus sp.
EELYMPPLVIKVIDHR

SEQ ID NO: 3448 - protein, 23 aa, Mus sp.
LMEKIQASVATNPIITPVAQENQ

SEQ ID NO: 3449 - protein, 18 aa, Mus sp.
ITGVDFIGSTVGLAKVSA

SEQ ID NO: 3450 - protein, 13 aa, Mus sp.
WTYNPAAVSKVAP

SEQ ID NO: 3451 - protein, 16 aa, Mus sp.
MGRERYNFPNPNPFVE

SEQ ID NO: 3452 - protein, 13 aa, Mus sp.
GKKFTAPHILIAT

SEQ ID NO: 3453 - protein, 14 aa, Mus sp.
FDNYEGSAPNLYVW

SEQ ID NO: 3454 - protein, 24 aa, Mus sp.
EKWEETELDQLFSGPLPGRLPVNH

SEQ ID NO: 3455 - protein, 13 aa, Mus sp.
VPSRDYAYSIING

SEQ ID NO: 3456 - protein, 15 aa, Mus sp.
LNLDWQYPGSRGSPP

SEQ ID NO: 3457 - protein, 15 aa, Mus sp.
GTPEYLAPEIILSKG

SEQ ID NO: 3458 - protein, 16 aa, Mus sp.
SLQAFSNPSAGISVDV

SEQ ID NO: 3459 - protein, 21 aa, Mus sp.
SDPSKTGIGAPTISTGPPGKY

SEQ ID NO: 3460 - protein, 15 aa, Mus sp.
ELVRAPTAALSPEPQ

SEQ ID NO: 3461 - protein, 15 aa, Mus sp.
GPKVNVEAPNVNMEG

SEQ ID NO: 3462 - protein, 16 aa, Mus sp.
KPTVTVVSPLPNDSIN

SEQ ID NO: 3463 - protein, 20 aa, Mus sp.
APPKPQDAFSDSQPASAAES

SEQ ID NO: 3464 - protein, 24 aa, Mus sp.
LPDGRIIKVGGERFEAPEALFQPH

SEQ ID NO: 3465 - protein, 17 aa, Mus sp.
RAKQIVWNGPVGVFEWE

SEQ ID NO: 3466 - protein, 17 aa, Mus sp.
ATPRDYYFALAHTVRDH

SEQ ID NO: 3467 - protein, 15 aa, Mus sp.
VGVNEYGLPMAVAQV

SEQ ID NO: 3468 - protein, 11 aa, Mus sp.
HPIQWNAPEPS

SEQ ID NO: 3469 - protein, 16 aa, Mus sp.
EVAFNGPKGGYVALDD

SEQ ID NO: 3470 - protein, 17 aa, Mus sp.
TVKSFVGPTPAPAPAPR

SEQ ID NO: 3471 - protein, 17 aa, Mus sp.
FAISYVAALPAAALWHK

SEQ ID NO: 3472 - protein, 13 aa, Mus sp.
IPYQGPSSDYVVV

SEQ ID NO: 3473 - protein, 16 aa, Mus sp.
GPYDFYQHPNVAEARQ

SEQ ID NO: 3474 - protein, 16 aa, Mus sp.
SKEAFQEALAAAGDKL

SEQ ID NO: 3475 - protein, 17 aa, Mus sp.
DSRTNTAYVGSAILSEE

SEQ ID NO: 3476 - protein, 14 aa, Mus sp.
REGSYEAAKILLDH

SEQ ID NO: 3477 - protein, 21 aa, Mus sp.
DPGESKSYSYSEVLPTEGPPS

SEQ ID NO: 3478 - protein, 12 aa, Mus sp.
RYNPPIIHQGFQ

SEQ ID NO: 3479 - protein, 17 aa, Mus sp.
DRNRPYVFSAPSESVEL

SEQ ID NO: 3480 - protein, 21 aa, Mus sp.
FLYQQQGRLDKLTITSQNLQL

SEQ ID NO: 3481 - protein, 14 aa, Mus sp.
MAPYQGPDAAPGAL

SEQ ID NO: 3482 - protein, 16 aa, Mus sp.
TWSDAAAPFAGLSTDQ

SEQ ID NO: 3483 - protein, 14 aa, Mus sp.
YIEGYVPSQADVAV

SEQ ID NO: 3484 - protein, 16 aa, Mus sp.
VLIPYQGPSSDYVVVK

SEQ ID NO: 3485 - protein, 19 aa, Mus sp.
KLTGMAFRVPTPNVSVVDL

SEQ ID NO: 3486 - protein, 22 aa, Mus sp.
EPSPVSETVVTPEAAPEKNPVD

SEQ ID NO: 3487 - protein, 15 aa, Mus sp.
GVNEYGLPMAVAQVL

SEQ ID NO: 3488 - protein, 16 aa, Mus sp.
RDLKWGTPVPLEGFED

SEQ ID NO: 3489 - protein, 22 aa, Mus sp.
VPPAGGGDPEAPAPAPAAERPP

SEQ ID NO: 3490 - protein, 18 aa, Mus sp.
VLITDKFWGPSGAESVIG

SEQ ID NO: 3491 - protein, 14 aa, Mus sp.
LPYTASSGLMAPRE

SEQ ID NO: 3492 - protein, 15 aa, Mus sp.
GKPAQYIAVHVVPDQ

SEQ ID NO: 3493 - protein, 22 aa, Mus sp.
DEDLETKKFRFEEPVVLPDLSD

SEQ ID NO: 3494 - protein, 19 aa, Mus sp.
EGNMHYDTPDIRRFDPVPA

SEQ ID NO: 3495 - protein, 20 aa, Mus sp.
NQGTVIHFNNPKVQASLAAN

SEQ ID NO: 3496 - protein, 14 aa, Mus sp.
DEAYVQPEPLGVVL

SEQ ID NO: 3497 - protein, 17 aa, Mus sp.
ELYRPSFVHPGAATVPT

SEQ ID NO: 3498 - protein, 16 aa, Mus sp.
DVVHGFYNPAVSRIVE

SEQ ID NO: 3499 - protein, 18 aa, Mus sp.
YPRDISNYGFPRSVQAID

SEQ ID NO: 3500 - protein, 16 aa, Mus sp.
LPENFRRPQTDQAVEF

SEQ ID NO: 3501 - protein, 18 aa, Mus sp.
DFYPFDGPSGLLAHAFPP

SEQ ID NO: 3502 - protein, 16 aa, Mus sp.
TSWTYNPAAVSKVAPA

SEQ ID NO: 3503 - protein, 19 aa, Mus sp.
GKLTGMAFRVPTPNVSVVD

SEQ ID NO: 3504 - protein, 25 aa, Mus sp.
KGADKTVKGPDGLTALEATDNQAIK

SEQ ID NO: 3505 - protein, 13 aa, Mus sp.
DNYRFAHTNIESL

SEQ ID NO: 3506 - protein, 14 aa, Mus sp.
QKTQYISPNLNPND

SEQ ID NO: 3507 - protein, 17 aa, Mus sp.
TPENEDLHAATVNPDPS

SEQ ID NO: 3508 - protein, 16 aa, Mus sp.
DTIEFRGPNGLLVYQG

SEQ ID NO: 3509 - protein, 16 aa, Mus sp.
LTPWLAPIVSEGTFDP

SEQ ID NO: 3510 - protein, 14 aa, Mus sp.
EDFYGSPIPSVSLK

SEQ ID NO: 3511 - protein, 16 aa, Mus sp.
TQVQWNDPGAQYSLVN

SEQ ID NO: 3512 - protein, 15 aa, Mus sp.
DIYVWRGAQATLSNT

SEQ ID NO: 3513 - protein, 15 aa, Mus sp.
TTTWQRPTAEYVRNY

SEQ ID NO: 3514 - protein, 16 aa, Mus sp.
GSVTYIAPPGNYDASD

SEQ ID NO: 3515 - protein, 14 aa, Mus sp.
AEEYEFLTPMEEAP

SEQ ID NO: 3516 - protein, 6 aa, Mus sp.
LVEKIF

SEQ ID NO: 3517 - protein, 28 aa, Mus sp.
KVIPELNGKLTGMAFRVPTPNVSVVDLT

SEQ ID NO: 3518 - protein, 17 aa, Mus sp.
VPDVDISSPGINVEAPD

SEQ ID NO: 3519 - protein, 14 aa, Mus sp.
YTRYHCSLPVPEPS

SEQ ID NO: 3520 - protein, 15 aa, Mus sp.
WKFTITPPSAQVVGV

SEQ ID NO: 3521 - protein, 16 aa, Mus sp.
FINIYSASSVSEVNDG

SEQ ID NO: 3522 - protein, 14 aa, Mus sp.
SQPLLLGIACNETS

SEQ ID NO: 3523 - protein, 15 aa, Mus sp.
AIFSYEAAQPEDLEF

SEQ ID NO: 3524 - protein, 15 aa, Mus sp.
IYYAGPVNNPGLDVP

SEQ ID NO: 3525 - protein, 19 aa, Mus sp.
AGEFDYSGSQAIKALKEEN

SEQ ID NO: 3526 - protein, 10 aa, BOVIN
VVPPFLQPEV

SEQ ID NO: 3527 - protein, 8 aa, BOVIN
VYPFPGPI

SEQ ID NO: 3528 - protein, 17 aa, BOVIN
YQEPVLGPVRGPFPIIV

SEQ ID NO: 3529 - protein, 18 aa, BOVIN
GPPVASVVVGPSVVAVPL

SEQ ID NO: 3530 - protein, 17 aa, BOVIN
PPVASVVVGPSVVAVPL

SEQ ID NO: 3531 - protein, 18 aa, Listeria monocytogenes
GTKEKVVATPVSNVSTSS

SEQ ID NO: 3532 - protein, 22 aa, Listeria monocytogenes
APGAELIYGHKAASREEFATWA

SEQ ID NO: 3533 - protein, 19 aa, Listeria monocytogenes
DFRYVFDTAKATAASSYPG

SEQ ID NO: 3534 - protein, 17 aa, Listeria monocytogenes
GINQAYTGSTALSDGLN

SEQ ID NO: 3535 - protein, 16 aa, Mus sp.
TVDVVLTPLVAEALDR

SEQ ID NO: 3536 - protein, 16 aa, Mus sp.
LTVLEGDPYFTGKLQD

SEQ ID NO: 3537 - protein, 17 aa, Mus sp.
EFPDNYNSPTPYKIQYN

SEQ ID NO: 3538 - protein, 12 aa, Mus sp.
IPFYTPIPNGLY

SEQ ID NO: 3539 - protein, 18 aa, Mus sp.
IHKSFVEVNEEGTEAAAA

SEQ ID NO: 3540 - protein, 17 aa, Mus sp.
GALLLNAPVVSITQGRN

SEQ ID NO: 3541 - protein, 15 aa, Mus sp.
AEQEVLAPQVVLSLG

SEQ ID NO: 3542 - protein, 14 aa, Mus sp.
IRYMAPEVLEGAVN

SEQ ID NO: 3543 - protein, 20 aa, Mus sp.
REPPPAYEPPAPAPAPLPPP

SEQ ID NO: 3544 - protein, 17 aa, Mus sp.
IGDSNFGAPSASVAAAP

SEQ ID NO: 3545 - protein, 18 aa, Mus sp.
IGDSNFGAPSASVAAAPA

SEQ ID NO: 3546 - protein, 19 aa, Mus sp.
IGDSNFGAPSASVAAAPAP

SEQ ID NO: 3547 - protein, 19 aa, Mus sp.
DPTPDPNTAYASYPSASVE

SEQ ID NO: 3548 - protein, 20 aa, Mus sp.
DPTPDPNTAYASYPSASVEN

SEQ ID NO: 3549 - protein, 22 aa, Mus sp.
DPTPDPNTAYASYPSASVENYQ

SEQ ID NO: 3550 - protein, 25 aa, Mus sp.
DPTPDPNTAYASYPSASVENYQQPP

SEQ ID NO: 3551 - protein, 23 aa, Mus sp.
TPDPNTAYASYPSASVENYQQPP

SEQ ID NO: 3552 - protein, 20 aa, Mus sp.
VDPTPDPNTAYASYPSASVE

SEQ ID NO: 3553 - protein, 21 aa, Mus sp.
VDPTPDPNTAYASYPSASVEN

SEQ ID NO: 3554 - protein, 22 aa, Mus sp.
YVDPTPDPNTAYASYPSASVEN

SEQ ID NO: 3555 - protein, 16 aa, Mus sp.
DISNYGFPRSVQAIDA

SEQ ID NO: 3556 - protein, 17 aa, Mus sp.
DISNYGFPRSVQAIDAA

SEQ ID NO: 3557 - protein, 19 aa, Mus sp.
WGIDPYDQPNAIYIERHEP

SEQ ID NO: 3558 - protein, 19 aa, Mus sp.
EPPPPRSHYSNIEANESEE

SEQ ID NO: 3559 - protein, 21 aa, Mus sp.
EPPPPRSHYSNIEANESEEVR

SEQ ID NO: 3560 - protein, 14 aa, Mus sp.
VTQFHPPHIEIQML

SEQ ID NO: 3561 - protein, 15 aa, Mus sp.
YVTQFHPPHIEIQML

SEQ ID NO: 3562 - protein, 16 aa, Mus sp.
YVTQFHPPHIEIQMLK

SEQ ID NO: 3563 - protein, 19 aa, Mus sp.
HSMRYFETAVSRPGLEEPR

SEQ ID NO: 3564 - protein, 20 aa, Mus sp.
HSMRYFETAVSRPGLEEPRY

SEQ ID NO: 3565 - protein, 18 aa, Mus sp.
DFLKKWETPSQNTAQLDQ

SEQ ID NO: 3566 - protein, 19 aa, Mus sp.
EDFLKKWETPSQNTAQLDQ

SEQ ID NO: 3567 - protein, 16 aa, Mus sp.
TKNLDYVATSIHEAVT

SEQ ID NO: 3568 - protein, 14 aa, Mus sp.
VYIFYGASIASLSA

SEQ ID NO: 3569 - protein, 17 aa, Mus sp.
VYIFYGASIASLSASHS

SEQ ID NO: 3570 - protein, 16 aa, Mus sp.
GSLFLKTPKIVSSKDY

SEQ ID NO: 3571 - protein, 19 aa, Mus sp.
LQHGSLFLKTPKIVSSKDY

SEQ ID NO: 3572 - protein, 14 aa, Mus sp.
SLFLKTPKIVSSKD

SEQ ID NO: 3573 - protein, 12 aa, Mus sp.
NPIITPVAQENQ

SEQ ID NO: 3574 - protein, 13 aa, Mus sp.
TNPIITPVAQENQ

SEQ ID NO: 3575 - protein, 17 aa, Mus sp.
SPTSPSYSPTSPNYSPT

SEQ ID NO: 3576 - protein, 17 aa, Mus sp.
SPTSPSYSPTSPSYSPT

SEQ ID NO: 3577 - protein, 17 aa, Mus sp.
TPQSPTYTPSSPSYSPS

SEQ ID NO: 3578 - protein, 15 aa, Mus sp.
TSPSYSPTSPNYSPT

SEQ ID NO: 3579 - protein, 15 aa, Mus sp.
SSEVYTFPVPERHLE

SEQ ID NO: 3580 - protein, 14 aa, Mus sp.
IKIAWESPQGQVSR

SEQ ID NO: 3581 - protein, 14 aa, Mus sp.
RSNEFDYPSVGQLA

SEQ ID NO: 3582 - protein, 17 aa, Mus sp.
AGNFYVPAEPKLAFVIR

SEQ ID NO: 3583 - protein, 14 aa, Mus sp.
TPATNEAPQATVFP

SEQ ID NO: 3584 - protein, 13 aa, Mus sp.
AEYWNSQPEILER

SEQ ID NO: 3585 - protein, 12 aa, Mus sp.
QPNVVISLSRTE

SEQ ID NO: 3586 - protein, 15 aa, Mus sp.
STQLIRNGDWTFQVL

SEQ ID NO: 3587 - protein, 14 aa, Mus sp.
TQLIRNGDWTFQVL

SEQ ID NO: 3588 - protein, 16 aa, Mus sp.
GYKPFQNPVPNQSPSS

SEQ ID NO: 3589 - protein, 25 aa, Mus sp.
IPELNGKLTGMAFRVPTPNVSVVDL

SEQ ID NO: 3590 - protein, 15 aa, Mus sp.
KKAGYITPVPGGVGP

SEQ ID NO: 3591 - protein, 20 aa, Mus sp.
DGELTYENVQVSPVPGGPPG

SEQ ID NO: 3592 - protein, 19 aa, Mus sp.
GELTYENVQVSPVPGGPPG

SEQ ID NO: 3593 - protein, 17 aa, Mus sp.
LDLLQQRAPVPASTSVL

SEQ ID NO: 3594 - protein, 17 aa, Mus sp.
ERFGVRFPAMSDAYDRD

SEQ ID NO: 3595 - protein, 15 aa, Mus sp.
LEEIYLFSLPIKESE

SEQ ID NO: 3596 - protein, 18 aa, Mus sp.
DGEEAGAYDGPRTADGIV

SEQ ID NO: 3597 - protein, 19 aa, Mus sp.
DGEEAGAYDGPRTADGIVS

SEQ ID NO: 3598 - protein, 16 aa, Mus sp.
LRDNYRFAHTNIESLV

SEQ ID NO: 3599 - protein, 14 aa, Mus sp.
NLRDNYRFAHTNIE

SEQ ID NO: 3600 - protein, 16 aa, Mus sp.
EDRRYNPPIIHQGFQD

SEQ ID NO: 3601 - protein, 19 aa, Mus sp.
EKEDRRYNPPIIHQGFQDT

SEQ ID NO: 3602 - protein, 22 aa, Mus sp.
EMEKEDRRYNPPIIHQGFQDTS

SEQ ID NO: 3603 - protein, 16 aa, Mus sp.
KEDRRYNPPIIHQGFQ

SEQ ID NO: 3604 - protein, 17 aa, Mus sp.
KEDRRYNPPIIHQGFQD

SEQ ID NO: 3605 - protein, 18 aa, Mus sp.
KEDRRYNPPIIHQGFQDT

SEQ ID NO: 3606 - protein, 10 aa, Mus sp.
LWPWPQYIQT

SEQ ID NO: 3607 - protein, 15 aa, Mus sp.
GQLPDYTSPVVLPYS

SEQ ID NO: 3608 - protein, 13 aa, Mus sp.
DNIFLSPLSISTA

SEQ ID NO: 3609 - protein, 14 aa, Mus sp.
DNIFLSPLSISTAF

SEQ ID NO: 3610 - protein, 19 aa, Mus sp.
GDFYPFDGPSGLLAHAFPP

SEQ ID NO: 3611 - protein, 15 aa, Mus sp.
YEDKVYWTDVINEAI

SEQ ID NO: 3612 - protein, 16 aa, Mus sp.
GPKPFSAPKPQTSPSP

SEQ ID NO: 3613 - protein, 17 aa, Mus sp.
GPKPFSAPKPQTSPSPK

SEQ ID NO: 3614 - protein, 18 aa, Mus sp.
GPKPFSAPKPQTSPSPKP

SEQ ID NO: 3615 - protein, 19 aa, Mus sp.
GPKPFSAPKPQTSPSPKPA

SEQ ID NO: 3616 - protein, 13 aa, Mus sp.
HTLFHNPHVNPLP

SEQ ID NO: 3617 - protein, 14 aa, Mus sp.
SPAEYAGPEGSYFG

SEQ ID NO: 3618 - protein, 17 aa, Mus sp.
EYPDSWSTPHSYFSLKF

SEQ ID NO: 3619 - protein, 13 aa, Mus sp.
GDSYRSPWSNKYD

SEQ ID NO: 3620 - protein, 19 aa, Mus sp.
NRDGDSYRSPWSNKYDPPL

SEQ ID NO: 3621 - protein, 15 aa, Mus sp.
EDVIAEPEGTHSFDG

SEQ ID NO: 3622 - protein, 8 aa, Mus sp.
INFDFPKL

SEQ ID NO: 3623 - protein, 16 aa, Mus sp.
DGIHHWTPPKGHVDPG

SEQ ID NO: 3624 - protein, 17 aa, Mus sp.
ISKQEYDESGPSIVHRK

SEQ ID NO: 3625 - protein, 14 aa, Mus sp.
GERFEAPEALFQPH

SEQ ID NO: 3626 - protein, 17 aa, Mus sp.
VGGERFEAPEALFQPHL

SEQ ID NO: 3627 - protein, 8 aa, Mus sp.
VNFEFPEF

SEQ ID NO: 3628 - protein, 20 aa, Mus sp.
VTYVPVTTFKNLQTVNVDEN

SEQ ID NO: 3629 - protein, 16 aa, Mus sp.
MSTHFWGPVANWGLPI

SEQ ID NO: 3630 - protein, 9 aa, Mus sp.
LDFGSLSNL

SEQ ID NO: 3631 - protein, 15 aa, Mus sp.
TDLRFQSSAVMALQE

SEQ ID NO: 3632 - protein, 19 aa, Mus sp.
YPSQASIYSPPAAAAAAAA

SEQ ID NO: 3633 - protein, 16 aa, Mus sp.
SMPDYKPSFPKWARQD

SEQ ID NO: 3634 - protein, 16 aa, Mus sp.
LFYLALPPTVYEAVTK

SEQ ID NO: 3635 - protein, 19 aa, Mus sp.
LITGVDFIGSTVGLAKVSA

SEQ ID NO: 3636 - protein, 20 aa, Mus sp.
LLPLGEPTAVYKVRTPSAAT

SEQ ID NO: 3637 - protein, 14 aa, Mus sp.
GPPIFNPVANEVYL

SEQ ID NO: 3638 - protein, 19 aa, Mus sp.
EDGDMRLVNGASANEGRVE

SEQ ID NO: 3639 - protein, 16 aa, Mus sp.
LTTSSYSNPTIGYENR

SEQ ID NO: 3640 - protein, 25 aa, Mus sp.
GSEIDLKGIPVYRFVLPANAFASPL

SEQ ID NO: 3641 - protein, 14 aa, Mus sp.
IPVYRFVLPANAFA

SEQ ID NO: 3642 - protein, 15 aa, Mus sp.
LPANAFASPLQNPDN

SEQ ID NO: 3643 - protein, 24 aa, Mus sp.
SEIDLKGIPVYRFVLPANAFASPL

SEQ ID NO: 3644 - protein, 14 aa, Mus sp.
GDLAIYAAAVPVSL

SEQ ID NO: 3645 - protein, 16 aa, Mus sp.
AAELQTLAPAINWLPF

SEQ ID NO: 3646 - protein, 15 aa, Mus sp.
INIYSASSVSEVNDG

SEQ ID NO: 3647 - protein, 14 aa, Mus sp.
SKNVFLSPMSISSA

SEQ ID NO: 3648 - protein, 15 aa, Mus sp.
RTDWEAPTGQPSAPG

SEQ ID NO: 3649 - protein, 15 aa, Mus sp.
GTPYWMSPEVISGEG

SEQ ID NO: 3650 - protein, 15 aa, Mus sp.
LDDFEAGTATAAPPG

SEQ ID NO: 3651 - protein, 21 aa, Mus sp.
SNKIPEVDMARVVAPFMSNIP

SEQ ID NO: 3652 - protein, 14 aa, Mus sp.
SSIASFKDPKISTS

SEQ ID NO: 3653 - protein, 15 aa, Mus sp.
SSIASFKDPKISTSL

SEQ ID NO: 3654 - protein, 18 aa, Mus sp.
GPRPEEYEFLTPVEEAPK

SEQ ID NO: 3655 - protein, 17 aa, Mus sp.
ARQNFTEPTAIQAQGWP

SEQ ID NO: 3656 - protein, 14 aa, Mus sp.
RQNFTEPTAIQAQG

SEQ ID NO: 3657 - protein, 15 aa, Mus sp.
YHFVTPLTSMVVTKP

SEQ ID NO: 3658 - protein, 16 aa, Mus sp.
KPSGYNPPISILGILE

SEQ ID NO: 3659 - protein, 16 aa, Mus sp.
DFVAWATGEPNFANDD

SEQ ID NO: 3660 - protein, 17 aa, Mus sp.
DFVAWATGEPNFANDDE

SEQ ID NO: 3661 - protein, 12 aa, Mus sp.
RYMAPEVLESRM

SEQ ID NO: 3662 - protein, 18 aa, Mus sp.
GPEPGPYAQPSVNTPLPN

SEQ ID NO: 3663 - protein, 15 aa, Mus sp.
TVIHFNNPKVQASLA

SEQ ID NO: 3664 - protein, 8 aa, Mus sp.
SSFVFLNL

SEQ ID NO: 3665 - protein, 14 aa, Mus sp.
MAFRVPTPNVSVVD

SEQ ID NO: 3666 - protein, 13 aa, Mus sp.
RYMAPEVLDDSIN

SEQ ID NO: 3667 - protein, 23 aa, Mus sp.
LPDLTNIHFPSPLPTPLDPEEPP

SEQ ID NO: 3668 - protein, 16 aa, Mus sp.
EDPDGFSWPATLPSVY

SEQ ID NO: 3669 - protein, 20 aa, Mus sp.
LEDPDGFSWPATLPSVYKQP

SEQ ID NO: 3670 - protein, 20 aa, Mus sp.
HPPQEATNSPKPQPSYEELE

SEQ ID NO: 3671 - protein, 16 aa, Mus sp.
DPIQKYLTPQMATSIT

SEQ ID NO: 3672 - protein, 19 aa, Mus sp.
SPVSETVVTPEAAPEKNPV

SEQ ID NO: 3673 - protein, 19 aa, Mus sp.
KGMKAFVSFVQAYAKHECS

SEQ ID NO: 3674 - protein, 19 aa, Mus sp.
NPTDEYLDAMMNEAPGPIN

SEQ ID NO: 3675 - protein, 23 aa, Mus sp.
TPARAPETRSQVTPSVPSEALDD

SEQ ID NO: 3676 - protein, 18 aa, Mus sp.
TRSQVTPSVPSEALDDST

SEQ ID NO: 3677 - protein, 17 aa, Mus sp.
DSKLHHGHDPRGGLQPS

SEQ ID NO: 3678 - protein, 24 aa, Mus sp.
TSPDWAGDMTQGHRSQEELSGPES

SEQ ID NO: 3679 - protein, 12 aa, Mus sp.
VNWYAPLVAPIS

SEQ ID NO: 3680 - protein, 14 aa, Mus sp.
NERFRCPEAIFQPS

SEQ ID NO: 3681 - protein, 15 aa, Mus sp.
VPIYEGYALPHAILR

SEQ ID NO: 3682 - protein, 18 aa, Mus sp.
VPIYEGYALPHAILRLDL

SEQ ID NO: 3683 - protein, 17 aa, Mus sp.
VQIPKVVKSPSSLPAKP

SEQ ID NO: 3684 - protein, 17 aa, Mus sp.
INPDNVATPIAASLGDL

SEQ ID NO: 3685 - protein, 14 aa, Mus sp.
FDIFYTAPQPGKYV

SEQ ID NO: 3686 - protein, 15 aa, Mus sp.
NRYWGTPIPLWVSED

SEQ ID NO: 3687 - protein, 16 aa, Mus sp.
GREVSSVEAPSVSPAR

SEQ ID NO: 3688 - protein, 13 aa, Mus sp.
VSSVEAPSVSPAR

SEQ ID NO: 3689 - protein, 14 aa, Mus sp.
IPDYWDPAALPDLG

SEQ ID NO: 3690 - protein, 15 aa, Mus sp.
SIPDYWDPAALPDLG

SEQ ID NO: 3691 - protein, 17 aa, Mus sp.
VLRYNITHPVVNDADAS

SEQ ID NO: 3692 - protein, 16 aa, Mus sp.
SILWSQPLPSLPGGPP

SEQ ID NO: 3693 - protein, 16 aa, Mus sp.
VRIDQYQGADAVGLEE

SEQ ID NO: 3694 - protein, 15 aa, Mus sp.
GLPDYSAPNPIKVTH

SEQ ID NO: 3695 - protein, 16 aa, Mus sp.
AVLEQEPIVLPAWDPM

SEQ ID NO: 3696 - protein, 17 aa, Mus sp.
LAVLEQEPIVLPAWDPM

SEQ ID NO: 3697 - protein, 17 aa, Mus sp.
WQGGVYASPSIAGSRPG

SEQ ID NO: 3698 - protein, 17 aa, Mus sp.
DGDSVVFAGPAGNSVET

SEQ ID NO: 3699 - protein, 16 aa, Mus sp.
SESSVSTPSASFEPDV

SEQ ID NO: 3700 - protein, 18 aa, Mus sp.
KPTVTVVSPLPNDSINPQ

SEQ ID NO: 3701 - protein, 23 aa, Mus sp.
KPTVTVVSPLPNDSINPQPSPDG

SEQ ID NO: 3702 - protein, 14 aa, Mus sp.
EEWGPFKAPHANRF

SEQ ID NO: 3703 - protein, 14 aa, Mus sp.
TTVEYLAPWANQID

SEQ ID NO: 3704 - protein, 13 aa, Mus sp.
IVYEGPELNHAFG

SEQ ID NO: 3705 - protein, 14 aa, Mus sp.
KIVYEGPELNHAFG

SEQ ID NO: 3706 - protein, 17 aa, Mus sp.
KWKALYTDPKSSETAAF

SEQ ID NO: 3707 - protein, 17 aa, Mus sp.
VNKGFYKEATQLWGKAE

SEQ ID NO: 3708 - protein, 16 aa, Mus sp.
APMYYRGSAAAVIVYD

SEQ ID NO: 3709 - protein, 14 aa, Mus sp.
GPVAPFVAAIPLLA

SEQ ID NO: 3710 - protein, 16 aa, Mus sp.
VPTVPLLPPQVNQSLA

SEQ ID NO: 3711 - protein, 16 aa, Mus sp.
YYNEVHSPSVAVEMGM

SEQ ID NO: 3712 - protein, 16 aa, Mus sp.
EPYAHAAPESIPATFE

SEQ ID NO: 3713 - protein, 13 aa, Mus sp.
IILENYAYPGVLL

SEQ ID NO: 3714 - protein, 20 aa, Mus sp.
SPPSTPDSASAPSTTPASPA

SEQ ID NO: 3715 - protein, 13 aa, Mus sp.
YYRGAQAAIVVYD

SEQ ID NO: 3716 - protein, 13 aa, Mus sp.
VIHFNNPKVQASL

SEQ ID NO: 3717 - protein, 16 aa, Mus sp.
GGSPYIAAKINEAKDL

SEQ ID NO: 3718 - protein, 18 aa, Mus sp.
SPTGNIFFSPFSISSALA

SEQ ID NO: 3719 - protein, 9 aa, Mus sp.
VILLPKDIE

SEQ ID NO: 3720 - protein, 15 aa, Mus sp.
FDQGYEAPGVREAAA

SEQ ID NO: 3721 - protein, 19 aa, Mus sp.
QPTGPPPYHESLAGASQPP

SEQ ID NO: 3722 - protein, 16 aa, Mus sp.
DHPGNYVEPTIVTGLA

SEQ ID NO: 3723 - protein, 16 aa, Mus sp.
AQAAMEEPVVQPSVVD

SEQ ID NO: 3724 - protein, 15 aa, Mus sp.
EVLDYSTPTTNGTPE

SEQ ID NO: 3725 - protein, 18 aa, Mus sp.
VPYPFQWGMPTVSAAGVI

SEQ ID NO: 3726 - protein, 16 aa, Mus sp.
TPRDYYFALAHTVRDH

SEQ ID NO: 3727 - protein, 13 aa, Mus sp.
LPYKSPGINVDSS

SEQ ID NO: 3728 - protein, 16 aa, Mus sp.
DIYVWRGAQATLSNTT

SEQ ID NO: 3729 - protein, 15 aa, Mus sp.
SSIYYISSTIAYAVG

SEQ ID NO: 3730 - protein, 17 aa, Mus sp.
DDLPTTFQGATASTSYG

SEQ ID NO: 3731 - protein, 16 aa, Mus sp.
DLPTTFQGATASTSYG

SEQ ID NO: 3732 - protein, 16 aa, Mus sp.
LPEYANAEIVRTRDPE

SEQ ID NO: 3733 - protein, 18 aa, Mus sp.
ATPAPSAPAAASATSPSP

SEQ ID NO: 3734 - protein, 24 aa, Mus sp.
GPDGKGMNPPSYYTQPVPVPNANA

SEQ ID NO: 3735 - protein, 17 aa, Mus sp.
GPYQAAAGPSVVPTAPP

SEQ ID NO: 3736 - protein, 14 aa, Mus sp.
PPSYYTQPVPVPNA

SEQ ID NO: 3737 - protein, 15 aa, Mus sp.
PPSYYTQPVPVPNAN

SEQ ID NO: 3738 - protein, 25 aa, Mus sp.
TGPDGKGMNPPSYYTQPVPVPNANA

SEQ ID NO: 3739 - protein, 15 aa, Mus sp.
DHVDFSQPEPHTVLF

SEQ ID NO: 3740 - protein, 17 aa, Mus sp.
KGQDHVDFSQPEPHTVL

SEQ ID NO: 3741 - protein, 16 aa, Mus sp.
RFTYQNAAAQPETGPG

SEQ ID NO: 3742 - protein, 15 aa, Mus sp.
YIPTYTKPNPNQIIS

SEQ ID NO: 3743 - protein, 16 aa, Mus sp.
IPSGLFIPSMAVGAIA

SEQ ID NO: 3744 - protein, 15 aa, Mus sp.
SLVQTYVGAISNGSL

SEQ ID NO: 3745 - protein, 8 aa, Mus sp.
SNYVFVFL

SEQ ID NO: 3746 - protein, 16 aa, Mus sp.
VLDNYLTSPLPEEVDE

SEQ ID NO: 3747 - protein, 15 aa, Mus sp.
RKIVYEGPELNHAFG

SEQ ID NO: 3748 - protein, 17 aa, Mus sp.
DGDSYRSPWSNKYDPPL

SEQ ID NO: 3749 - protein, 15 aa, Mus sp.
SMFLHINETYLLMEQ

SEQ ID NO: 3750 - protein, 16 aa, Mus sp.
RFTYQNAAAQPETGPG

SEQ ID NO: 3751 - protein, 16 aa, Listeria monocytogenes
GTKEKVVATPVSNVST

SEQ ID NO: 3752 - protein, 16 aa, Mus sp.
IGNERFRCPEAIFQPS

SEQ ID NO: 3753 - protein, 14 aa, Mus sp.
SKTVYALPTIAFAF

SEQ ID NO: 3754 - protein, 16 aa, Mus sp.
DGDSYRSPWSNKYDPP

SEQ ID NO: 3755 - protein, 16 aa, Mus sp.
FQHPYNTLKYPNGEGG

SEQ ID NO: 3756 - protein, 19 aa, Mus sp.
SPRDDARVYHDPSTQEPVT

SEQ ID NO: 3757 - protein, 21 aa, Mus sp.
EKWEETELDQLFSGPLPGRLP

SEQ ID NO: 3758 - protein, 18 aa, Mus sp.
DVVDRVLKSPVASIVYEL

SEQ ID NO: 3759 - protein, 14 aa, Mus sp.
DRRYNPPIIHQGFQ

SEQ ID NO: 3760 - protein, 15 aa, Mus sp.
RTDWEAPTGQPSAPG

SEQ ID NO: 3761 - protein, 18 aa, Mus sp.
RPGLSYHYAHSHLAEEEG

SEQ ID NO: 3762 - protein, 21 aa, Mus sp.
TPSPESPDQWSSSSPHSASDW

SEQ ID NO: 3763 - protein, 15 aa, Mus sp.
NHTLFHNPHVNPLPT

SEQ ID NO: 3764 - protein, 30 aa, Mus sp.; identical to SEQ ID NO: 3326

SEQ ID NO: 3765 - protein, 15 aa, Mus sp.
DQKFYNFVVIHARAD

SEQ ID NO: 3766 - protein, 19 aa, Mus sp.
SPESPDQWSSSSPHSASDW

SEQ ID NO: 3767 - protein, 19 aa, Mus sp.
YNIPFTEKNILYSAFLWRT

SEQ ID NO: 3768 - protein, 18 aa, Mus sp.
EKTGQEYKPGNPSAAAVQ

SEQ ID NO: 3769 - protein, 16 aa, Mus sp.
LRDNYRFAHTNIESLV

SEQ ID NO: 3770 - protein, 15 aa, Mus sp.
SKQEYDESGPSIVHR

SEQ ID NO: 3771 - protein, 16 aa, Mus sp.
FSFGKINPHYTVKGLE

SEQ ID NO: 3772 - protein, 17 aa, Mus sp.
GNHTLFHNPHVNPLPTG

SEQ ID NO: 3773 - protein, 18 aa, Mus sp.
DGIHHWTPPKGHVDPGEN

SEQ ID NO: 3774 - protein, 19 aa, Mus sp.
APETRSQVTPSVPSEALDD

SEQ ID NO: 3775 - protein, 16 aa, Mus sp.
SPDQWSSSSPHSASDW

SEQ ID NO: 3776 - protein, 16 aa, Mus sp.
SSVAFIKPGVNKAEVT

SEQ ID NO: 3777 - protein, 6 aa, Mus sp.
LVEKIF

SEQ ID NO: 3778 - protein, 23 aa, Listeria monocytogenes
RYVFDTAKATAASSYPGSDETPP

SEQ ID NO: 3779 - protein, 14 aa, Mus sp.
GDIEHPRAIALDPR

SEQ ID NO: 3780 - protein, 16 aa, Mus sp.
KKELEEQLGPVAEETR

SEQ ID NO: 3781 - protein, 15 aa, Mus sp.
NLKHVAGAAAAGAVV

SEQ ID NO: 3782 - protein, 33 aa, Listeria monocytogenes; identical to SEQ ID NO: 210

SEQ ID NO: 3783 - protein, 19 aa, Mus sp.
DGREVSSVEAPSVSPARHQ

SEQ ID NO: 3784 - protein, 16 aa, Mus sp.
APVEGASPTSISAVDG

SEQ ID NO: 3785 - protein, 15 aa, Mus sp.
KGQDHVDFSQPEPHT

SEQ ID NO: 3786 - protein, 11 aa, Mus sp.
RYMAPEVLESR

SEQ ID NO: 3787 - protein, 17 aa, Mus sp.
KLLEAKGPVTDVAYSHD

SEQ ID NO: 3788 - protein, 20 aa, Mus sp.
DPTPDPNTAYASYPSASVEN

SEQ ID NO: 3789 - protein, 15 aa, Mus sp.
VDFDFAGPAIHGSAV

SEQ ID NO: 3790 - protein, 14 aa, Mus sp.
RKIVYEGPELNHAF

SEQ ID NO: 3791 - protein, 12 aa, Mus sp.
IEVAPPKAHEVR

SEQ ID NO: 3792 - protein, 17 aa, Mus sp.
ESPDQWSSSSPHSASDW

SEQ ID NO: 3793 - protein, 18 aa, Mus sp.
EAIETIVAAMSNLVPPVE

SEQ ID NO: 3794 - protein, 12 aa, Mus sp.
RQTTQYPEANAL

SEQ ID NO: 3795 - protein, 12 aa, Mus sp.
EDRRYNPPIIHQ

SEQ ID NO: 3796 - protein, 18 aa, Mus sp.
TPDPNTAYASYPSASVEN

SEQ ID NO: 3797 - protein, 17 aa, Mus sp.
DSPDVVYSPETIEARYE

SEQ ID NO: 3798 - protein, 21 aa, Mus sp.
GIKADKADKAAASGPASASAP

SEQ ID NO: 3799 - protein, 15 aa, Mus sp.
FVNYSNAVTLHLGNN

SEQ ID NO: 3800 - protein, 19 aa, Mus sp.
EMEKEDRRYNPPIIHQGFQ

SEQ ID NO: 3801 - protein, 16 aa, Mus sp.
EPRVLPYHPAQPGQAT

SEQ ID NO: 3802 - protein, 18 aa, Mus sp.
GRRTDWEAPTGQPSAPGP

SEQ ID NO: 3803 - protein, 23 aa, Mus sp.
DKNGNPLNSVFVAPAVTPVKGVL

SEQ ID NO: 3804 - protein, 16 aa, Mus sp.
GYPTAYPAAAPAYNPS

SEQ ID NO: 3805 - protein, 16 aa, Mus sp.
DVDFDFAGPAIHGSAV

SEQ ID NO: 3806 - protein, 15 aa, Mus sp.
GDLEYQMSTTARAKR

SEQ ID NO: 3807 - protein, 18 aa, Mus sp.
LPQDPTFHTPLDLYAYAR

SEQ ID NO: 3808 - protein, 17 aa, Mus sp.
SSIASFKDPKISTSLPV

SEQ ID NO: 3809 - protein, 17 aa, Mus sp.
ATPRDYYFALAHTVRDH

SEQ ID NO: 3810 - protein, 15 aa, Mus sp.
RAGYKAAIVHNVDSD

SEQ ID NO: 3811 - protein, 18 aa, Mus sp.
FPKPPSYNVATTLPSYDE

SEQ ID NO: 3812 - protein, 16 aa, Mus sp.
GIPVYRFVLPANAFAS

SEQ ID NO: 3813 - protein, 15 aa, Mus sp.
VEPYEVHNPVPLIVG

SEQ ID NO: 3814 - protein, 15 aa, Mus sp.
YTIPFYTPIPNGLYP

SEQ ID NO: 3815 - protein, 17 aa, Mus sp.
VLRYNITHPVVNDADAS

SEQ ID NO: 3816 - protein, 15 aa, Mus sp.
DNMFSGSKINYTENR

SEQ ID NO: 3817 - protein, 14 aa, Mus sp.
KQEYDESGPSIVHR

SEQ ID NO: 3818 - protein, 16 aa, Mus sp.
ITDKFWGPSGAESVIG

SEQ ID NO: 3819 - protein, 13 aa, Mus sp.
IPFYTPIPNGLYP

SEQ ID NO: 3820 - protein, 17 aa, Mus sp.
LHQALKMLWQNLHQFGQ

SEQ ID NO: 3821 - protein, 15 aa, Mus sp.
GKFIYITPEELAAVA

SEQ ID NO: 3822 - protein, 15 aa, Mus sp.
VPIYEGYALPHAILR

SEQ ID NO: 3823 - protein, 15 aa, Mus sp.
ITPSYVAFTPEGERL

SEQ ID NO: 3824 - protein, 16 aa, Mus sp.
YPNSFSAPEQQRSALE

SEQ ID NO: 3825 - protein, 15 aa, Mus sp.
NRPAFMPSEGRMVSD

SEQ ID NO: 3826 - protein, 16 aa, Mus sp.
FGTGHSAPSASPAFGA

SEQ ID NO: 3827 - protein, 18 aa, Mus sp.
SPPPGGYGQPSVLPGGYP

SEQ ID NO: 3828 - protein, 18 aa, Mus sp.
EQIYYAGPVNNPGLDVPQ

SEQ ID NO: 3829 - protein, 15 aa, Mus sp.
KLLEAKGPVTDVAYS

SEQ ID NO: 3830 - protein, 7 aa, Mus sp.
SIASFKD

SEQ ID NO: 3831 - protein, 16 aa, Mus sp.
GSLFLKTPKIVSSKDY

SEQ ID NO: 3832 - protein, 8 aa, Mus sp.
PKISTSLP

SEQ ID NO: 3833 - protein, 16 aa, Mus sp.
DSENMEREAETVDLDD

SEQ ID NO: 3834 - protein, 12 aa, Mus sp.
TPDYIAPEILQG

SEQ ID NO: 3835 - protein, 17 aa, Mus sp.
GDSVVFAGPAGNSVETR

SEQ ID NO: 3836 - protein, 14 aa, Mus sp.
GDDWTIFQSNHSTY

SEQ ID NO: 3837 - protein, 16 aa, Mus sp.
DPDGFSWPATLPSVYK

SEQ ID NO: 3838 - protein, 14 aa, Mus sp.
LEDFYGSPIPSVSL

SEQ ID NO: 3839 - protein, 20 aa, Mus sp.
APETRSQVTPSVPSEALDDS

SEQ ID NO: 3840 - protein, 13 aa, Mus sp.
GVDFIGSTVGLAK

SEQ ID NO: 3841 - protein, 19 aa, Mus sp.
KPTVTVVSPLPNDSINPQP

SEQ ID NO: 3842 - protein, 28 aa, Mus sp.
KVIPELNGKLTGMAFRVPTPNVSVVDLT

SEQ ID NO: 3843 - protein, 17 aa, Mus sp.
KIPPDVLQDMAVIAPML

SEQ ID NO: 3844 - protein, 15 aa, Mus sp.
LEDFYGSPIPSVSLK

SEQ ID NO: 3845 - protein, 20 aa, Mus sp.
LPPYDDATAVPSTAKEPPPP

SEQ ID NO: 3846 - protein, 21 aa, Mus sp.
SDPSKTGIGAPTISTGPPGKY

SEQ ID NO: 3847 - protein, 18 aa, Mus sp.
GPNFEYAEAPSRLSPDDA

SEQ ID NO: 3848 - protein, 16 aa, Mus sp.
VTRQTTQYPEANALVR

SEQ ID NO: 3849 - protein, 16 aa, Mus sp.
KPPSYNVATTLPSYDE

SEQ ID NO: 3850 - protein, 18 aa, Mus sp.
DPDSRGEYSWAVAQGVKQ

SEQ ID NO: 3851 - protein, 16 aa, Mus sp.
ITPSYVAFTPEGERLI

SEQ ID NO: 3852 - protein, 18 aa, Mus sp.
DKDPFWWNGAEPIWVTNQ

SEQ ID NO: 3853 - protein, 17 aa, Mus sp.
KGADKTVKGPDGLTALE

SEQ ID NO: 3854 - protein, 15 aa, Mus sp.
KQREEYQPATPGLGM

SEQ ID NO: 3855 - protein, 12 aa, Mus sp.
SVFVAPAVTPVK

SEQ ID NO: 3856 - protein, 15 aa, Mus sp.
GSLFLKTPKIVSSKD

SEQ ID NO: 3857 - protein, 17 aa, Mus sp.
GEFDYSGSQAIKALKEE

SEQ ID NO: 3858 - protein, 19 aa, Mus sp.
FPKPPSYNVATTLPSYDEA

SEQ ID NO: 3859 - protein, 15 aa, Mus sp.
TAQWNICLPLLQHNL

SEQ ID NO: 3860 - protein, 21 aa, Mus sp.
DPTPDPNTAYASYPSASVENY

SEQ ID NO: 3861 - protein, 14 aa, Mus sp.
NLRDNYRFAHTNIE

SEQ ID NO: 3862 - protein, 13 aa, Mus sp.
RYMAPEVLDEHIR

SEQ ID NO: 3863 - protein, 19 aa, Mus sp.
GLNVLRIINEPTAAAIAYG

SEQ ID NO: 3864 - protein, 22 aa, Mus sp.
RAPETRSQVTPSVPSEALDDST

SEQ ID NO: 3865 - protein, 20 aa, Mus sp.
DGHGGYKPFQNPVPNQSPSS

SEQ ID NO: 3866 - protein, 16 aa, Mus sp.
FKKPSWLTPVPESHKL

SEQ ID NO: 3867 - protein, 15 aa, Mus sp.
VYTRYHCSLPVPEPS

SEQ ID NO: 3868 - protein, 16 aa, Mus sp.
GPKPFSAPKPQTSPSP

SEQ ID NO: 3869 - protein, 14 aa, Mus sp.
RLDNYDAPDIANIA

SEQ ID NO: 3870 - protein, 15 aa, Mus sp.
GTPEYLAPEIILSKG

SEQ ID NO: 3871 - protein, 11 aa, Mus sp.
GAWTGPMGNWA

SEQ ID NO: 3872 - protein, 16 aa, Mus sp.
DPIQKYLTPQMATSIT

SEQ ID NO: 3873 - protein, 15 aa, Mus sp.
FRLWDFRDPSIHSVN

SEQ ID NO: 3874 - protein, 21 aa, Mus sp.
DVVDRVLKSPVASIVYELNPN

SEQ ID NO: 3875 - protein, 17 aa, Mus sp.
SPTVHFTPAEISRSVFE

SEQ ID NO: 3876 - protein, 16 aa, Mus sp.
AGGDARNKKLPNGPAF

SEQ ID NO: 3877 - protein, 14 aa, Mus sp.
DNMFSGSKINYTEN

SEQ ID NO: 3878 - protein, 17 aa, Mus sp.
FPPEFYEHAKALWEDEG

SEQ ID NO: 3879 - protein, 17 aa, Mus sp.
GPNFEYAEAPSRLSPDD

SEQ ID NO: 3880 - protein, 19 aa, Mus sp.
APQGSLGEYLFERLTLKHD

SEQ ID NO: 3881 - protein, 15 aa, Mus sp.
APPLPIKTPIPTPST

SEQ ID NO: 3882 - protein, 12 aa, Listeria monocytogenes
EVVYHNMKQDLE

SEQ ID NO: 3883 - protein, 17 aa, Mus sp.
GPPPYHESLAGASQPPY

SEQ ID NO: 3884 - protein, 15 aa, Mus sp.
EQIYYAGPVNNPGLD

SEQ ID NO: 3885 - protein, 15 aa, Mus sp.
IDPYDQPNAIYIERH

SEQ ID NO: 3886 - protein, 17 aa, Mus sp.
RITPSYVAFTPEGERLI

SEQ ID NO: 3887 - protein, 26 aa, Mus sp.
KDAGTIAGLNVLRIINEPTAAAIAYG

SEQ ID NO: 3888 - protein, 16 aa, Listeria monocytogenes
KEKVVATPVSNVSTSS

SEQ ID NO: 3889 - protein, 14 aa, Mus sp.
EDRRYNPPIIHQGF

SEQ ID NO: 3890 - protein, 15 aa, Mus sp.
SGKIEVEKPFAIAKE

SEQ ID NO: 3891 - protein, 18 aa, Mus sp.
RPVKESYSGPSTALTYPS

SEQ ID NO: 3892 - protein, 17 aa, Mus sp.
SLQAFSNPSAGISVDVK

SEQ ID NO: 3893 - protein, 17 aa, Mus sp.
APMYYRGAQAAIVVYDI

SEQ ID NO: 3894 - protein, 16 aa, Mus sp.
LEDFYGSPIPSVSLKL

SEQ ID NO: 3895 - protein, 17 aa, Mus sp.
LNVLRIINEPTAAAIAY

SEQ ID NO: 3896 - protein, 16 aa, Mus sp.
IARQNFTEPTAIQAQG

SEQ ID NO: 3897 - protein, 16 aa, Mus sp.
AIETIVAAMSNLVPPV

SEQ ID NO: 3898 - protein, 18 aa, Mus sp.
GNMHYDTPDIRRFDPVPA

SEQ ID NO: 3899 - protein, 17 aa, Listeria monocytogenes
TKEKVVATPVSNVSTSS

SEQ ID NO: 3900 - protein, 18 aa, Mus sp.
SIASFKDPKISTSLPVLD

SEQ ID NO: 3901 - protein, 14 aa, Mus sp.
NPPSYYTQPVPVPN

SEQ ID NO: 3902 - protein, 18 aa, Mus sp.
MEKEDRRYNPPIIHQGFQ

SEQ ID NO: 3903 - protein, 17 aa, Mus sp.
LKYHFVTPLTSMVVTKP

SEQ ID NO: 3904 - protein, 17 aa, Mus sp.
GDMPTKLRRLDVHANQE

SEQ ID NO: 3905 - protein, 16 aa, Mus sp.
AAYLWVGAGASEAEKT

SEQ ID NO: 3906 - protein, 14 aa, Mus sp.
TSSYYRGAHGIIVV

SEQ ID NO: 3907 - protein, 14 aa, Mus sp.
GPVAPFVAAIPLLA

SEQ ID NO: 3908 - protein, 18 aa, Mus sp.
DSPDVVYSPETIEARYEY

SEQ ID NO: 3909 - protein, 16 aa, Mus sp.
LSLKYHFVTPLTSMVV

SEQ ID NO: 3910 - protein, 16 aa, Mus sp.
SPHPYQLPQALAPHVD

SEQ ID NO: 3911 - protein, 20 aa, Mus sp.
QPSTSSLAAPTVEAAASAPA

SEQ ID NO: 3912 - protein, 19 aa, Mus sp.
RAKQIVWNGPVGVFEWEAF

SEQ ID NO: 3913 - protein, 27 aa, Mus sp.
KVIPELNGKLTGMAFRVPTPNVSVVDL

SEQ ID NO: 3914 - protein, 14 aa, Mus sp.
TNDQNQNGNHTLPQ

SEQ ID NO: 3915 - protein, 16 aa, Mus sp.
DPNTAYASYPSASVEN

SEQ ID NO: 3916 - protein, 12 aa, Mus sp.
EAGAFNAPVINR

SEQ ID NO: 3917 - protein, 15 aa, Mus sp.
VTPWKAPIVWEGTYD

SEQ ID NO: 3918 - protein, 20 aa, Mus sp.
HSMRYFETAVSRPGLEEPRY

SEQ ID NO: 3919 - protein, 14 aa, Mus sp.
LRDNYRFAHTNIES

SEQ ID NO: 3920 - protein, 23 aa, Mus sp.
GIKADKADKAAASGPASASAPAA

SEQ ID NO: 3921 - protein, 16 aa, Mus sp.
YTIPFYTPIPNGLYPS

SEQ ID NO: 3922 - protein, 14 aa, Mus sp.
TKWFSAPLLLEASE

SEQ ID NO: 3923 - protein, 19 aa, Mus sp.
GPGGKWMIPPEAKESMDKN

SEQ ID NO: 3924 - protein, 16 aa, Mus sp.
IPITYPTTAPEIAVPE

SEQ ID NO: 3925 - protein, 15 aa, Mus sp.
AEQEVLAPQVVLSLG

SEQ ID NO: 3926 - protein, 21 aa, Mus sp.
RPDAFAISYVAALPAAALWHK

SEQ ID NO: 3927 - protein, 15 aa, Mus sp.
SVTYYGPSGQKTIYS

SEQ ID NO: 3928 - protein, 17 aa, Mus sp.
EQIYYAGPVNNPGLDVP

SEQ ID NO: 3929 - protein, 20 aa, Mus sp.
DPAGPNFEYAEAPSRLSPDD

SEQ ID NO: 3930 - protein, 18 aa, Mus sp.
RSFFWNVAPGAESAVASF

SEQ ID NO: 3931 - protein, 19 aa, Mus sp.
ENHIEVWERPLSNLAWAVA

SEQ ID NO: 3932 - protein, 25 aa, Mus sp.
KGADKTVKGPDGLTALEATDNQAIK

SEQ ID NO: 3933 - protein, 15 aa, Listeria monocytogenes
YMEKHSVSRLVGAPP

SEQ ID NO: 3934 - protein, 12 aa, Mus sp.
VAFNGPKGGYVA

SEQ ID NO: 3935 - protein, 23 aa, Listeria monocytogenes
VETKADIDALSLLSDKIFVTNQT

SEQ ID NO: 3936 - protein, 17 aa, Mus sp.
DEAQVEFMASHGNEAAR

SEQ ID NO: 3937 - protein, 18 aa, Mus sp.
EDYVELPPSVSQAATSPP

SEQ ID NO: 3938 - protein, 18 aa, Mus sp.
AGEFDYSGSQAIKALKEE

SEQ ID NO: 3939 - protein, 20 aa, Mus sp.
EMEKEDRRYNPPIIHQGFQD

SEQ ID NO: 3940 - protein, 15 aa, Mus sp.
ELEEQLGPVAEETRA

SEQ ID NO: 3941 - protein, 12 aa, Mus sp.
YTIPFYTPIPNG

SEQ ID NO: 3942 - protein, 18 aa, BOVIN
PPVASVVVGPSVVAVPLP

SEQ ID NO: 3943 - protein, 17 aa, Mus sp.
FPTDYPFKPPKVAFTTR

SEQ ID NO: 3944 - protein, 16 aa, Mus sp.
KNLDYVATSIHEAVTK

SEQ ID NO: 3945 - protein, 14 aa, Mus sp.
LPYKSPGINVDSSY

SEQ ID NO: 3946 - protein, 19 aa, Mus sp.
GDLSWHPALTTKSKMRDPH

SEQ ID NO: 3947 - protein, 17 aa, Mus sp.
YSAFSYVDPVITSISPR

SEQ ID NO: 3948 - protein, 11 aa, Mus sp.
IPFYTPIPNGL

SEQ ID NO: 3949 - protein, 14 aa, Mus sp.
EDNVFEAPTLVKVF

SEQ ID NO: 3950 - protein, 17 aa, Mus sp.
ITKQEYDEAGPSIVHRK

SEQ ID NO: 3951 - protein, 17 aa, Mus sp.
KPPSYNVATTLPSYDEA

SEQ ID NO: 3952 - protein, 15 aa, Mus sp.
YYLPYKSPGINVDSS

SEQ ID NO: 3953 - protein, 16 aa, Mus sp.
EWKDYKAGFGNLEREF

SEQ ID NO: 3954 - protein, 14 aa, Mus sp.
DLLYSFPVVIKNKT

SEQ ID NO: 3955 - protein, 17 aa, Mus sp.
MPDMHFKAPKISMPDVD

SEQ ID NO: 3956 - protein, 19 aa, BOVIN
GPPVASVVVGPSVVAVPLP

SEQ ID NO: 3957 - protein, 15 aa, Mus sp.
DRRYNPPIIHQGFQD

SEQ ID NO: 3958 - protein, 17 aa, Mus sp.
LPRSQYDYVLPQVSFTA

SEQ ID NO: 3959 - protein, 28 aa, Mus sp.
LLDFGSLSNLQVTQPTVGMNFKTPRGAV

SEQ ID NO: 3960 - protein, 18 aa, Mus sp.
LNVLRVINEPTAAALAYG

SEQ ID NO: 3961 - protein, 17 aa, Mus sp.
IPPTHYAASRAASVAEN

SEQ ID NO: 3962 - protein, 15 aa, Mus sp.
LDKDSFSDPYAHVSF

SEQ ID NO: 3963 - protein, 17 aa, Mus sp.
VPSVIYTHPEVAWVGKS

SEQ ID NO: 3964 - protein, 17 aa, Mus sp.
HGLELEEPPLVLAAANV

SEQ ID NO: 3965 - protein, 18 aa, Mus sp.
APSEERVYMVGKANSVFE

SEQ ID NO: 3966 - protein, 14 aa, Mus sp.
ELEEQLGPVAEETR

SEQ ID NO: 3967 - protein, 9 aa, Mus sp.
VTYVPVTTF

SEQ ID NO: 3968 - protein, 15 aa, Mus sp.
DPTFHTPLDLYAYAR

SEQ ID NO: 3969 - protein, 14 aa, Mus sp.
ASFKDPKISTSLPV

SEQ ID NO: 3970 - protein, 17 aa, Mus sp.
NPPSYYTQPVPVPNANA

SEQ ID NO: 3971 - protein, 15 aa, Mus sp.
RESKVVVPPLPGKAF

SEQ ID NO: 3972 - protein, 16 aa, Mus sp.
KRSNEFDYPSVGQLAH

SEQ ID NO: 3973 - protein, 20 aa, Listeria monocytogenes
VDDTTVKFTLPTVAPAFENT

SEQ ID NO: 3974 - protein, 15 aa, Mus sp.
APISSHTAPRPNPTP

SEQ ID NO: 3975 - protein, 14 aa, Mus sp.
VTRQTTQYPEANAL

SEQ ID NO: 3976 - protein, 18 aa, Mus sp.
TALTFSSPATNQAITIPV

SEQ ID NO: 3977 - protein, 16 aa, Mus sp.
AAATTAAPAAAAAPAK

SEQ ID NO: 3978 - protein, 14 aa, Mus sp.
GDIFIGPKAEEHRG

SEQ ID NO: 3979 - protein, 17 aa, Mus sp.
GTPEYLAPEVLEDNDYG

SEQ ID NO: 3980 - protein, 15 aa, Mus sp.
APGGYVAPKAVWLPA

SEQ ID NO: 3981 - protein, 17 aa, Mus sp.
VPTDKYYGAQTVRSTMN

SEQ ID NO: 3982 - protein, 18 aa, Mus sp.
YDRALAVVYSVITPFLNP

SEQ ID NO: 3983 - protein, 17 aa, Mus sp.
VPDDLLYSFPVVIKNKT

SEQ ID NO: 3984 - protein, 14 aa, Mus sp.
GTPDYIAPEIIAYQ

SEQ ID NO: 3985 - protein, 16 aa, Mus sp.
LDQLFSGPLPGRLPVN

SEQ ID NO: 3986 - protein, 14 aa, Mus sp.
EEWGPFKAPHANRF

SEQ ID NO: 3987 - protein, 17 aa, Mus sp.
FGNSEFDPPGPNVATTT

SEQ ID NO: 3988 - protein, 19 aa, Mus sp.
SPPPYAAYATPTPEVYGYG

SEQ ID NO: 3989 - protein, 16 aa, Mus sp.
EAGAYDGPRTADGIVS

SEQ ID NO: 3990 - protein, 13 aa, Mus sp.
ELDYYDSPSVNAR

SEQ ID NO: 3991 - protein, 19 aa, Mus sp.
DGEEAGAYDGPRTADGIVS

SEQ ID NO: 3992 - protein, 14 aa, Mus sp.
VFDVTAPNTFKTLD

SEQ ID NO: 3993 - protein, 17 aa, Mus sp.
LDKDSFSDPYAHVSFLH

SEQ ID NO: 3994 - protein, 13 aa, Mus sp.
AEYWNSQPEILER

SEQ ID NO: 3995 - protein, 16 aa, Mus sp.
TSSYSNPTIGYENRVL

SEQ ID NO: 3996 - protein, 16 aa, Mus sp.
DQENKYQASHPNLRRL

SEQ ID NO: 3997 - protein, 15 aa, Mus sp.
HIPEFQLPHLSHTIE

SEQ ID NO: 3998 - protein, 18 aa, Mus sp.
HGLELEEPPLVLAAANVV

SEQ ID NO: 3999 - protein, 14 aa, Mus sp.
TPWKAPIVWEGTYD

SEQ ID NO: 4000 - protein, 14 aa, Mus sp.
ITTDYNSPEAGNIF

SEQ ID NO: 4001 - protein, 18 aa, Mus sp.
KLLEAKGPVTDVAYSHDG

SEQ ID NO: 4002 - protein, 17 aa, Mus sp.
LLPEYANAEIVRTRDPE

SEQ ID NO: 4003 - protein, 17 aa, Mus sp.
FRLWDFRDPSIHSVNVF

SEQ ID NO: 4004 - protein, 17 aa, Mus sp.
IQEMEKEDRRYNPPIIH

SEQ ID NO: 4005 - protein, 16 aa, Mus sp.
YPDSWSTPHSYFSLKF

SEQ ID NO: 4006 - protein, 20 aa, Mus sp.
SGPKPFSAPKPQTSPSPKPA

SEQ ID NO: 4007 - protein, 16 aa, Mus sp.
TVTPWKAPIVWEGTYD

SEQ ID NO: 4008 - protein, 17 aa, Mus sp.
EYQQYQDATAEEEEDFG

SEQ ID NO: 4009 - protein, 18 aa, Mus sp.
EVERRLTSPVINTSLDTK

SEQ ID NO: 4010 - protein, 13 aa, Mus sp.
DPYDQPNAIYIER

SEQ ID NO: 4011 - protein, 12 aa, Mus sp.
DSERHFVYQFMG

SEQ ID NO: 4012 - protein, 13 aa, Mus sp.
RSYSSPDITQALQ

SEQ ID NO: 4013 - protein, 13 aa, Mus sp.
IQEPYTFPAILKS

SEQ ID NO: 4014 - protein, 13 aa, Mus sp.
FPYVTPAPHEPVK

SEQ ID NO: 4015 - protein, 8 aa, Mus sp.
SALIYSNL

SEQ ID NO: 4016 - protein, 19 aa, Mus sp.
VGEVKDYEPPFGSKVREHP

SEQ ID NO: 4017 - protein, 15 aa, Mus sp.
AISYVAALPAAALWH

SEQ ID NO: 4018 - protein, 16 aa, Mus sp.
ITPSYYTTSDAVISTE

SEQ ID NO: 4019 - protein, 21 aa, Mus sp.
APETRSQVTPSVPSEALDDST

SEQ ID NO: 4020 - protein, 16 aa, Mus sp.
ESKIRYKTSEPVWEEN

SEQ ID NO: 4021 - protein, 17 aa, Mus sp.
SPPPYAAYATPTPEVYG

SEQ ID NO: 4022 - protein, 16 aa, Mus sp.
GREVSSVEAPSVSPAR

SEQ ID NO: 4023 - protein, 18 aa, Mus sp.
FPLKEDNWSLPNRAVEPQ

SEQ ID NO: 4024 - protein, 13 aa, Mus sp.
APDTRFVAPGALG

SEQ ID NO: 4025 - protein, 16 aa, Mus sp.
EEEYYAEPGVTEAEPV

SEQ ID NO: 4026 - protein, 15 aa, Mus sp.
EPSVFNGPEVTMLKD

SEQ ID NO: 4027 - protein, 13 aa, Mus sp.
GFVLLGATANEVR

SEQ ID NO: 4028 - protein, 15 aa, Mus sp.
GEFDYSGSQAIKALK

SEQ ID NO: 4029 - protein, 15 aa, Mus sp.
EAGAYDGPRTADGIV

SEQ ID NO: 4030 - protein, 14 aa, Mus sp.
TPDYIAPEILQGLK

SEQ ID NO: 4031 - protein, 12 aa, Mus sp.
IPFYTPIPNGLY

SEQ ID NO: 4032 - protein, 17 aa, Mus sp.
GIHHWTPPKGHVDPGEN

SEQ ID NO: 4033 - protein, 17 aa, Mus sp.
AGEFDYSGSQAIKALKE

SEQ ID NO: 4034 - protein, 16 aa, Mus sp.
DIYVWRGAQATLSNTT

SEQ ID NO: 4035 - protein, 15 aa, Mus sp.
IRGTSYQSPHGIPID

SEQ ID NO: 4036 - protein, 19 aa, Mus sp.
IGDTIEFRGPNGLLVYQGK

SEQ ID NO: 4037 - protein, 16 aa, Mus sp.
GKFIYITPEELAAVAN

SEQ ID NO: 4038 - protein, 15 aa, Mus sp.
GTPDYIAPEILQGLK

SEQ ID NO: 4039 - protein, 13 aa, Mus sp.
SVFVAPAVTPVKG

SEQ ID NO: 4040 - protein, 34 aa, Listeria monocytogenes; identical to SEQ ID NO: 591

SEQ ID NO: 4041 - protein, 16 aa, Mus sp.
AEIEYAMAYSKAAFER

SEQ ID NO: 4042 - protein, 19 aa, Mus sp.
VGAGHFRSPHTTEVVGGAP

SEQ ID NO: 4043 - protein, 22 aa, Mus sp.
GADELLKRVYGSFLVNPEPGYN

SEQ ID NO: 4044 - protein, 13 aa, Mus sp.
LMLYTRKFESTDP

SEQ ID NO: 4045 - protein, 24 aa, Mus sp.
EEKYHEALAKGDVTTQVALQPALK

SEQ ID NO: 4046 - protein, 14 aa, Mus sp.
VTYEWAPPVQNQAL

SEQ ID NO: 4047 - protein, 14 aa, Mus sp.
SIASFKDPKISTSL

SEQ ID NO: 4048 - protein, 15 aa, Mus sp.
SLKYHFVTPLTSMVV

SEQ ID NO: 4049 - protein, 14 aa, Mus sp.
SRVQIYHNPTANSF

SEQ ID NO: 4050 - protein, 14 aa, Mus sp.
SNPSYNYEIVNRAS

SEQ ID NO: 4051 - protein, 14 aa, Mus sp.
KEDRRYNPPIIHQG

SEQ ID NO: 4052 - protein, 21 aa, Mus sp.
LPEEVGEYRQPSGGSVPVSPG

SEQ ID NO: 4053 - protein, 15 aa, Mus sp.
IPKVVKSPSSLPAKP

SEQ ID NO: 4054 - protein, 11 aa, Mus sp.
RYMAPEVLDDS

SEQ ID NO: 4055 - protein, 26 aa, Mus sp.
EKWEETELDQLFSGPLPGRLPVNHRP

SEQ ID NO: 4056 - protein, 21 aa, Mus sp.
CALLTLRWPRPLTTLATAVTG

SEQ ID NO: 4057 - protein, 14 aa, Mus sp.
KQREEYQPATPGLG

SEQ ID NO: 4058 - protein, 14 aa, Mus sp.
DIFIGPKAEEHRGL

SEQ ID NO: 4059 - protein, 21 aa, Mus sp.
DPAGPNFEYAEAPSRLSPDDA

SEQ ID NO: 4060 - protein, 18 aa, Mus sp.
LPEEVGEYRQPSGGSVPV

SEQ ID NO: 4061 - protein, 14 aa, Mus sp.
IETIVAAMSNLVPP

SEQ ID NO: 4062 - protein, 15 aa, Mus sp.
SIASFKDPKISTSLP

SEQ ID NO: 4063 - protein, 13 aa, Mus sp.
SALEYGMPVTLIG

SEQ ID NO: 4064 - protein, 18 aa, Mus sp.
TPVFVHAGPFANIAHGNS

SEQ ID NO: 4065 - protein, 14 aa, Mus sp.
TARYMAPEVLESRM

SEQ ID NO: 4066 - protein, 16 aa, Mus sp.
FGPYYTEPVIAGLDPK

SEQ ID NO: 4067 - protein, 10 aa, Mus sp.
ALPKAVVKLD

SEQ ID NO: 4068 - protein, 17 aa, Mus sp.
EPYLEPRSPEARGVEAP

SEQ ID NO: 4069 - protein, 18 aa, Mus sp.
NTHDLDFRAPHVLVLGSG

SEQ ID NO: 4070 - protein, 15 aa, Mus sp.
RPEEVEAEAVNRSIT

SEQ ID NO: 4071 - protein, 22 aa, Mus sp.
AVNKGFYKEATQLWGKAEMIIE

SEQ ID NO: 4072 - protein, 16 aa, Mus sp.
YIEGYVPSQADVAVFE

SEQ ID NO: 4073 - protein, 14 aa, Mus sp.
IPFYTPIPNGLYPS

SEQ ID NO: 4074 - protein, 15 aa, Mus sp.
VFDVTAPNTFKTLDS

SEQ ID NO: 4075 - protein, 17 aa, Mus sp.
DTIEFRGPNGLLVYQGK

SEQ ID NO: 4076 - protein, 14 aa, Mus sp.
EALFYNHALPLPGF

SEQ ID NO: 4077 - protein, 15 aa, Mus sp.
AGNAFKKADPQEAIN

SEQ ID NO: 4078 - protein, 15 aa, Mus sp.
LTLMMPYYKLHPESP

SEQ ID NO: 4079 - protein, 17 aa, Mus sp.
APDTRFVAPGALGNAPW

SEQ ID NO: 4080 - protein, 19 aa, Mus sp.
TPDPNTAYASYPSASVENY

SEQ ID NO: 4081 - protein, 14 aa, Mus sp.
NELDYYDSPSVNAR

SEQ ID NO: 4082 - protein, 17 aa, Mus sp.
FPKPPSYNVATTLPSYD

SEQ ID NO: 4083 - protein, 19 aa, Mus sp.
DPTPDPNTAYASYPSASVE

SEQ ID NO: 4084 - protein, 14 aa, BOVIN
SVVVGPSVVAVPLP

SEQ ID NO: 4085 - protein, 16 aa, Mus sp.
EMNLMHAPQVADAILG

SEQ ID NO: 4086 - protein, 15 aa, Mus sp.
REGSYEAAKILLDHF

SEQ ID NO: 4087 - protein, 15 aa, Mus sp.
GPKPFSAPKPQTSPS

SEQ ID NO: 4088 - protein, 19 aa, Mus sp.
LPGNLDYWTYPGSLTTPPL

SEQ ID NO: 4089 - protein, 14 aa, Mus sp.
IDPYDQPNAIYIER

SEQ ID NO: 4090 - protein, 18 aa, Mus sp.
EWTKWVAGSTLPAWIPPS

SEQ ID NO: 4091 - protein, 17 aa, Mus sp.
EWKFTITPPSAQVVGVL

SEQ ID NO: 4092 - protein, 15 aa, Mus sp.
GDSYRSPWSNKYDPP

SEQ ID NO: 4093 - protein, 15 aa, Mus sp.
SKNVFLSPMSISSAL

SEQ ID NO: 4094 - protein, 18 aa, Mus sp.
GRADFREPNAQVSRPIPD

SEQ ID NO: 4095 - protein, 14 aa, Mus sp.
FPYVTPAPHEPVKT

SEQ ID NO: 4096 - protein, 12 aa, Mus sp.
GHKLGLGLEFQA

SEQ ID NO: 4097 - protein, 16 aa, Mus sp.
TITVYSFPESVELRPL

SEQ ID NO: 4098 - protein, 19 aa, Mus sp.
APGRDLHYQNPHSNAVGNP

SEQ ID NO: 4099 - protein, 15 aa, Mus sp.
TIPFYTPIPNGLYPS

SEQ ID NO: 4100 - protein, 19 aa, Mus sp.
KGQDHVDFSQPEPHTVLFH

SEQ ID NO: 4101 - protein, 16 aa, Mus sp.
GYAVYETPTAHNGAKN

SEQ ID NO: 4102 - protein, 14 aa, Mus sp.
EVSSVEAPSVSPAR

SEQ ID NO: 4103 - protein, 19 aa, Mus sp.
LPQDPTFHTPLDLYAYARA

SEQ ID NO: 4104 - protein, 19 aa, Mus sp.
APSNYLNNPYVRKALHIPE

SEQ ID NO: 4105 - protein, 18 aa, Mus sp.
RDGDSYRSPWSNKYDPPL

SEQ ID NO: 4106 - protein, 17 aa, Mus sp.
SPLVHVLMGNVYILFPP

SEQ ID NO: 4107 - protein, 17 aa, Mus sp.
GPVPEFSGATVERVSED

SEQ ID NO: 4108 - protein, 25 aa, Mus sp.
LPGVPPGLEFLVQIDQILIHQKAER

SEQ ID NO: 4109 - protein, 12 aa, Mus sp.
VEYEASAAGLIR

SEQ ID NO: 4110 - protein, 17 aa, Mus sp.
AGALAASAPVVAVAGLG

SEQ ID NO: 4111 - protein, 19 aa, Mus sp.
GSGNSTGFGEHGSSSHPLP

SEQ ID NO: 4112 - protein, 13 aa, Mus sp.
DNMFSGSKINYTE

SEQ ID NO: 4113 - protein, 17 aa, Mus sp.
GKKFTAPHILIATGGVP

SEQ ID NO: 4114 - protein, 22 aa, Mus sp.
EEKYHEALAKGDVTTQVALQPA

SEQ ID NO: 4115 - protein, 17 aa, Mus sp.
AEIEYAMAYSKAAFERE

SEQ ID NO: 4116 - protein, 19 aa, Mus sp.
GPEVDVSLPKANIDVSGPK

SEQ ID NO: 4117 - protein, 15 aa, Mus sp.
SKEFEFIESQTSSHR

SEQ ID NO: 4118 - protein, 24 aa, Mus sp.
FPGPNIGGDTHFDSAEPWTVQNED

SEQ ID NO: 4119 - protein, 31 aa, Mus sp.; identical to SEQ ID NO: 1455

SEQ ID NO: 4120 - protein, 13 aa, Mus sp.
SVGAWTGPMGNWA

SEQ ID NO: 4121 - protein, 17 aa, Mus sp.
EDITHTYKYPEGSPEER

SEQ ID NO: 4122 - protein, 21 aa, Mus sp.
GEMDEATRYLAPTILTDVDPN

SEQ ID NO: 4123 - protein, 29 aa, Mus sp.
AVGKVIPELNGKLTGMAFRVPTPNVSVVD

SEQ ID NO: 4124 - protein, 16 aa, Mus sp.
SPTGNIFFSPFSISSA

SEQ ID NO: 4125 - protein, 16 aa, Mus sp.
INDYKGAVIVVSHDAR

SEQ ID NO: 4126 - protein, 15 aa, Mus sp.
DKQREEYQPATPGLG

SEQ ID NO: 4127 - protein, 18 aa, Mus sp.
VPYPFQWGMPTVSAAGVI

SEQ ID NO: 4128 - protein, 17 aa, Mus sp.
YPYPTDFLGPLPANPVK

SEQ ID NO: 4129 - protein, 19 aa, Mus sp.
TPPSPKVTYKAPVPTGEVY

SEQ ID NO: 4130 - protein, 17 aa, Mus sp.
AKPSGYNPPISILGILE

SEQ ID NO: 4131 - protein, 12 aa, Mus sp.
RYNPPIIHQGFQ

SEQ ID NO: 4132 - protein, 14 aa, Mus sp.
KIGEHTPSALAIME

SEQ ID NO: 4133 - protein, 14 aa, Mus sp.
RQTTQYPEANALVR

SEQ ID NO: 4134 - protein, 14 aa, Mus sp.
EVQWQSAEPGSTPR

SEQ ID NO: 4135 - protein, 14 aa, Mus sp.
APMYYRGAQAAIVV

SEQ ID NO: 4136 - protein, 19 aa, Mus sp.
YPPSGPTYRGPVPWHTINL

SEQ ID NO: 4137 - protein, 16 aa, Mus sp.
KQIVWNGPVGVFEWEA

SEQ ID NO: 4138 - protein, 18 aa, Mus sp.
YKKELEEQLGPVAEETRA

SEQ ID NO: 4139 - protein, 14 aa, Mus sp.
NVNIFKFIIPNIVK

SEQ ID NO: 4140 - protein, 13 aa, Mus sp.
DFYGSPIPSVSLK

SEQ ID NO: 4141 - protein, 11 aa, Mus sp.
VLAPQVVLSLG

SEQ ID NO: 4142 - protein, 18 aa, Mus sp.
YPPSGPTYRGPVPWHTIN

SEQ ID NO: 4143 - protein, 21 aa, Mus sp.
GDSVTTDHISPAGNIARNSPA

SEQ ID NO: 4144 - protein, 17 aa, Listeria monocytogenes
TTVKFTLPTVAPAFENT

SEQ ID NO: 4145 - protein, 20 aa, BOVIN
GPPVASVVVGPSVVAVPLPL

SEQ ID NO: 4146 - protein, 19 aa, Mus sp.
LPKEELYMPPLVIKVIDHR

SEQ ID NO: 4147 - protein, 16 aa, Mus sp.
SKTVYEGPFASRSLSD

SEQ ID NO: 4148 - protein, 17 aa, Mus sp.
IDLKGIPVYRFVLPANA

SEQ ID NO: 4149 - protein, 18 aa, Mus sp.
VLEMYKVHNPVPLIVGSS

SEQ ID NO: 4150 - protein, 20 aa, Mus sp.
GPEAPLDELVGAYPNYNEEE

SEQ ID NO: 4151 - protein, 16 aa, Mus sp.
VKFKSFCLKHSQNKPK

SEQ ID NO: 4152 - protein, 17 aa, Mus sp.
MPDMHFKTPKISMPDVD

SEQ ID NO: 4153 - protein, 17 aa, Mus sp.
LPSTWSDPSVNISLDNL

SEQ ID NO: 4154 - protein, 15 aa, Mus sp.
EFDYSGSQAIKALKE

SEQ ID NO: 4155 - protein, 12 aa, Mus sp.
LPYKSPGINVDS

SEQ ID NO: 4156 - protein, 20 aa, Mus sp.
FEDYVELPPSVSQAATSPPG

SEQ ID NO: 4157 - protein, 15 aa, Mus sp.
GSFVYKGGKIYKVPS

SEQ ID NO: 4158 - protein, 16 aa, Mus sp.
IQRVQAMKSPDHNGED

SEQ ID NO: 4159 - protein, 16 aa, Mus sp.
VTNLRKMGAPEAGMAE

SEQ ID NO: 4160 - protein, 8 aa, Mus sp.
FNLVYENL

SEQ ID NO: 4161 - protein, 16 aa, Mus sp.
HADASFVAAIPSTQVV

SEQ ID NO: 4162 - protein, 17 aa, Mus sp.
RTDWEAPTGQPSAPGPR

SEQ ID NO: 4163 - protein, 15 aa, Mus sp.
KNLDYVATSIHEAVT

SEQ ID NO: 4164 - protein, 16 aa, Mus sp.
HDLDFRAPHVLVLGSG

SEQ ID NO: 4165 - protein, 12 aa, Mus sp.
YEWAPPVQNQAL

SEQ ID NO: 4166 - protein, 18 aa, Mus sp.
GADKTVKGPDGLTALEAT

SEQ ID NO: 4167 - protein, 14 aa, Mus sp.
FQINQDEEEEEDED

SEQ ID NO: 4168 - protein, 17 aa, Mus sp.
SPDDPSRYITPDQLADL

SEQ ID NO: 4169 - protein, 16 aa, Mus sp.
KERYSYVCPDLVKEFN

SEQ ID NO: 4170 - protein, 27 aa, Mus sp.
FPGPNIGGDTHFDSAEPWTVQNEDLNG

SEQ ID NO: 4171 - protein, 20 aa, Mus sp.
LPDLTNIHFPSPLPTPLDPE

SEQ ID NO: 4172 - protein, 19 aa, Mus sp.
EDYVELPPSVSQAATSPPG

SEQ ID NO: 4173 - protein, 13 aa, Mus sp.
RDYVPPTANLDQK

SEQ ID NO: 4174 - protein, 16 aa, Mus sp.
YPFDFQGAKIITGQEE

SEQ ID NO: 4175 - protein, 16 aa, Mus sp.
NVTELNEPLSNEERNL

SEQ ID NO: 4176 - protein, 16 aa, Mus sp.
NPPSYYTQPVPVPNAN

SEQ ID NO: 4177 - protein, 13 aa, Mus sp.
VLLPFFDPDTNIV

SEQ ID NO: 4178 - protein, 16 aa, Mus sp.
VPDDLLYSFPVVIKNK

SEQ ID NO: 4179 - protein, 16 aa, Mus sp.
EDYVELPPSVSQAATS

SEQ ID NO: 4180 - protein, 14 aa, Mus sp.
GVELYRAPFPLYAL

SEQ ID NO: 4181 - protein, 21 aa, Listeria monocytogenes
STVVVEAGDTLWGIAQSKGTT

SEQ ID NO: 4182 - protein, 17 aa, Mus sp.
ETELDQLFSGPLPGRLP

SEQ ID NO: 4183 - protein, 15 aa, Mus sp.
VNGKKFTAPHILIAT

SEQ ID NO: 4184 - protein, 19 aa, Mus sp.
DDPTAGHSNAPIAAPAEVE

SEQ ID NO: 4185 - protein, 12 aa, Mus sp.
APDTRFVAPGAL

SEQ ID NO: 4186 - protein, 13 aa, Mus sp.
EKEDRRYNPPIIH

SEQ ID NO: 4187 - protein, 12 aa, Mus sp.
TSWLDGKHVVFG

SEQ ID NO: 4188 - protein, 13 aa, Mus sp.
FKVLAPQISFGLD

SEQ ID NO: 4189 - protein, 18 aa, Mus sp.
AAPHIYQNSFVQVVLNSL

SEQ ID NO: 4190 - protein, 16 aa, Mus sp.
EDYVELPPSVSQAAKS

SEQ ID NO: 4191 - protein, 16 aa, Mus sp.
EDPDGFSWPATLPSVY

SEQ ID NO: 4192 - protein, 16 aa, Mus sp.
DTNLNDLGPRALEIYR

SEQ ID NO: 4193 - protein, 24 aa, Mus sp.
GDEDLETKKFRFEEPVVLPDLSDQ

SEQ ID NO: 4194 - protein, 18 aa, Mus sp.
DFYPFDGPSGLLAHAFPP

SEQ ID NO: 4195 - protein, 13 aa, Mus sp.
TPEYLAPEIILSK

SEQ ID NO: 4196 - protein, 15 aa, Listeria monocytogenes
YPGSDETPPVVNPGE

SEQ ID NO: 4197 - protein, 14 aa, Mus sp.
FEYAEAPSRLSPDD

SEQ ID NO: 4198 - protein, 22 aa, Mus sp.
RRKGEQIYYAGPVNNPGLDVPQ

SEQ ID NO: 4199 - protein, 17 aa, Mus sp.
LERESKVVVPPLPGKAF

SEQ ID NO: 4200 - protein, 16 aa, Mus sp.
MPDMHFKAPKISMPDV

SEQ ID NO: 4201 - protein, 20 aa, Mus sp.
KPTVTVVSPLPNDSINPQPS

SEQ ID NO: 4202 - protein, 15 aa, Mus sp.
VVIEVFTPVVQRILK

SEQ ID NO: 4203 - protein, 17 aa, Mus sp.
EEAGAYDGPRTADGIVS

SEQ ID NO: 4204 - protein, 14 aa, Mus sp.
RNIYWTDSVPGSVS

SEQ ID NO: 4205 - protein, 12 aa, Mus sp.
GLPDYSAPNPIK

SEQ ID NO: 4206 - protein, 15 aa, Mus sp.
LDYWTYPGSLTTPPL

SEQ ID NO: 4207 - protein, 17 aa, Mus sp.
DGKKFKLEAPDADELPR

SEQ ID NO: 4208 - protein, 15 aa, Mus sp.
LEGDIFIGPKAEEHR

SEQ ID NO: 4209 - protein, 14 aa, Mus sp.
RDYVPPTANLDQKD

SEQ ID NO: 4210 - protein, 17 aa, Mus sp.
SGPKPFSAPKPQTSPSP

SEQ ID NO: 4211 - protein, 16 aa, Mus sp.
GALLLNAPVVSITQGR

SEQ ID NO: 4212 - protein, 12 aa, Mus sp.
YKVHNPVPLIVG

SEQ ID NO: 4213 - protein, 14 aa, Mus sp.
AFSNPSAGISVDVK

SEQ ID NO: 4214 - protein, 16 aa, Mus sp.
DRKIVYEGPELNHAFG

SEQ ID NO: 4215 - protein, 14 aa, Mus sp.
SPDVVYSPETIEAR

SEQ ID NO: 4216 - protein, 18 aa, Mus sp.
GRIEHLYKNPQAHIEGNM

SEQ ID NO: 4217 - protein, 17 aa, Mus sp.
NPTDEYLDAMMNEAPGP

SEQ ID NO: 4218 - protein, 14 aa, Mus sp.
PPSYYTQPVPVPNA

SEQ ID NO: 4219 - protein, 14 aa, Mus sp.
IVYWMTSQPSDAVR

SEQ ID NO: 4220 - protein, 18 aa, Mus sp.
FPGAQHYVGGNAALIGQR

SEQ ID NO: 4221 - protein, 15 aa, Mus sp.
VVFEWKDPFIQKVQD

SEQ ID NO: 4222 - protein, 17 aa, Mus sp.
TPVFVHAGPFANIAHGN

SEQ ID NO: 4223 - protein, 15 aa, Mus sp.
YDVYRYLPPATQVVL

SEQ ID NO: 4224 - protein, 16 aa, Mus sp.
GTPDYIAPEILQGLKY

SEQ ID NO: 4225 - protein, 15 aa, Mus sp.
LPPVSPPKAALSVDE

SEQ ID NO: 4226 - protein, 11 aa, Mus sp.
SVFVAPRKGIY

SEQ ID NO: 4227 - protein, 17 aa, Listeria monocytogenes
DDTTVKFTLPTVAPAFE

SEQ ID NO: 4228 - protein, 17 aa, Mus sp.
QPYSHSTAPSALPALDS

SEQ ID NO: 4229 - protein, 17 aa, Mus sp.
DSKQYYQQPTATAAAVA

SEQ ID NO: 4230 - protein, 24 aa, Mus sp.
SPAPSTRVITNQYNSPTGLYSSEN

SEQ ID NO: 4231 - protein, 15 aa, Mus sp.
AINDYKGAVIVVSHD

SEQ ID NO: 4232 - protein, 19 aa, Mus sp.
LTGMAFRVPTPNVSVVDLT

SEQ ID NO: 4233 - protein, 16 aa, Mus sp.
VTYEWAPPVQNQALAR

SEQ ID NO: 4234 - protein, 21 aa, Mus sp.
GPHSMRYFETAVSRPGLEEPR

SEQ ID NO: 4235 - protein, 19 aa, Mus sp.
SPVSETVVTPEAAPEKNPV

SEQ ID NO: 4236 - protein, 14 aa, Mus sp.
LEPYLEPRSPEARG

SEQ ID NO: 4237 - protein, 22 aa, Mus sp.
VDHNTRTTTWQRPTAEYVRNYE

SEQ ID NO: 4238 - protein, 17 aa, Mus sp.
YKKELEEQLGPVAEETR

SEQ ID NO: 4239 - protein, 15 aa, Mus sp.
EWKDYKAGFGNLERE

SEQ ID NO: 4240 - protein, 27 aa, Mus sp.
GDQGRDGIPGPPGEKGETGLLGAYPGP

SEQ ID NO: 4241 - protein, 15 aa, Mus sp.
SEVYHEPHIADAWPQ

SEQ ID NO: 4242 - protein, 20 aa, Mus sp.
KPVPAAPVPSPVAPAPVPSR

SEQ ID NO: 4243 - protein, 17 aa, Mus sp.
VPDVQFKTPQISMSDID

SEQ ID NO: 4244 - protein, 15 aa, Mus sp.
LPNVQVEGPTPNRPR

SEQ ID NO: 4245 - protein, 16 aa, Mus sp.
LGEFDTPEAIWSSEMR

SEQ ID NO: 4246 - protein, 16 aa, Mus sp.
SVATNPIITPVAQENQ

SEQ ID NO: 4247 - protein, 19 aa, Mus sp.
KGADKTVKGPDGLTALEAT

SEQ ID NO: 4248 - protein, 17 aa, Mus sp.
LSLLYNVPAVAEEIQDE

SEQ ID NO: 4249 - protein, 19 aa, Mus sp.
HSMRYFETAVSRPGLEEPR

SEQ ID NO: 4250 - protein, 19 aa, Mus sp.
DERFGVRFPAMSDAYDRDM

SEQ ID NO: 4251 - protein, 19 aa, Mus sp.
NFHQRFESPDSQASAEQPE

SEQ ID NO: 4252 - protein, 15 aa, Mus sp.
AEDVTFIGPDTHAIQ

SEQ ID NO: 4253 - protein, 14 aa, Mus sp.
FPIKWTAPEAINFG

SEQ ID NO: 4254 - protein, 13 aa, Mus sp.
LIEVSSPITLQAL

SEQ ID NO: 4255 - protein, 14 aa, Mus sp.
SVGAWTGPMGNWAM

SEQ ID NO: 4256 - protein, 15 aa, Mus sp.
APNLHFHNPNPEIPA

SEQ ID NO: 4257 - protein, 15 aa, Mus sp.
EQRATFHTPEAPPNL

SEQ ID NO: 4258 - protein, 17 aa, Mus sp.
RPVFDWKDPLILEEQLT

SEQ ID NO: 4259 - protein, 18 aa, Mus sp.
GKKFTAPHILIATGGVPT

SEQ ID NO: 4260 - protein, 28 aa, Mus sp.
NVDPFKAVDTNRASMGQASPESKGFTDL

SEQ ID NO: 4261 - protein, 16 aa, Mus sp.
EYQQYQDATAEEEGEF

SEQ ID NO: 4262 - protein, 14 aa, Mus sp.
IPEFQLPHLSHTIE

SEQ ID NO: 4263 - protein, 14 aa, Mus sp.
SRGEYSWAVAQGVK

SEQ ID NO: 4264 - protein, 26 aa, Mus sp.
GGLDSLIGDSNFGAPSASVAAAPAPA

SEQ ID NO: 4265 - protein, 15 aa, Mus sp.
SKIRYKTSEPVWEEN

SEQ ID NO: 4266 - protein, 16 aa, Mus sp.
DGNHTLFHNPHVNPLP

SEQ ID NO: 4267 - protein, 15 aa, Mus sp.
KELEEQLGPVAEETR

SEQ ID NO: 4268 - protein, 18 aa, Mus sp.
VSPTVHFTPAEISRSVFE

SEQ ID NO: 4269 - protein, 16 aa, Mus sp.
SFPKFKGSLALRTLDL

SEQ ID NO: 4270 - protein, 24 aa, Mus sp.
SEIDLKGIPVYRFVLPANAFASPL

SEQ ID NO: 4271 - protein, 12 aa, Mus sp.
FRVPTPNVSVVD

SEQ ID NO: 4272 - protein, 15 aa, Mus sp.
GKPYVLPSVRKAEAQ

SEQ ID NO: 4273 - protein, 15 aa, BOVIN
SVVVGPSVVAVPLPL

SEQ ID NO: 4274 - protein, 15 aa, Mus sp.
GYAVYETPTAHNGAK

SEQ ID NO: 4275 - protein, 15 aa, Mus sp.
DIRWQQPSPSPTGPY

SEQ ID NO: 4276 - protein, 15 aa, Mus sp.
NLRDNYRFAHTNIES

SEQ ID NO: 4277 - protein, 16 aa, Mus sp.
GAQEMVSSSVSSAKET

SEQ ID NO: 4278 - protein, 16 aa, Mus sp.
APPHFHFGQTNRTPEF

SEQ ID NO: 4279 - protein, 16 aa, Mus sp.
VKVIYKAPSENWAMEG

SEQ ID NO: 4280 - protein, 18 aa, Mus sp.
EPTTLFKTASALRSSAPL

SEQ ID NO: 4281 - protein, 18 aa, Listeria monocytogenes
EAKELVDNAPKALKEGIA

SEQ ID NO: 4282 - protein, 18 aa, Mus sp.
DGDSVVFAGPAGNSVETR

SEQ ID NO: 4283 - protein, 15 aa, Mus sp.
DPTNPFRFPNIGVEK

SEQ ID NO: 4284 - protein, 18 aa, Mus sp.
LPKEELYMPPLVIKVIDH

SEQ ID NO: 4285 - protein, 14 aa, Mus sp.
TAPEYYAPEVHQHD

SEQ ID NO: 4286 - protein, 15 aa, Mus sp.
SFKDPKISTSLPVLD

SEQ ID NO: 4287 - protein, 15 aa, Mus sp.
SFPKFKGSLALRTLD

SEQ ID NO: 4288 - protein, 30 aa, Mus sp.; identical to SEQ ID NO: 1868

SEQ ID NO: 4289 - protein, 20 aa, Mus sp.
TPSSPSYSPSSPSYSPTSPK

SEQ ID NO: 4290 - protein, 16 aa, Mus sp.
VFDVTAPNTFKTLDSW

SEQ ID NO: 4291 - protein, 8 aa, Mus sp.
ASYEFTTL

SEQ ID NO: 4292 - protein, 18 aa, Mus sp.
EDYVELPPSVSQAAKSPP

SEQ ID NO: 4293 - protein, 14 aa, Mus sp.
VYIFYGASIASLSA

SEQ ID NO: 4294 - protein, 19 aa, Mus sp.
QPPPAYEPPAPAPAPLPPP

SEQ ID NO: 4295 - protein, 17 aa, Mus sp.
AANVYTTVVAELVRGGQ

SEQ ID NO: 4296 - protein, 15 aa, Mus sp.
LPQDPTFHTPLDLYA

SEQ ID NO: 4297 - protein, 20 aa, Mus sp.
APSEERVYMVGKANSVFEDL

SEQ ID NO: 4298 - protein, 16 aa, Listeria monocytogenes
VERWNEKYAQAYPNVS

SEQ ID NO: 4299 - protein, 18 aa, Mus sp.
RTDWEAPTGQPSAPGPRP

SEQ ID NO: 4300 - protein, 20 aa, Listeria monocytogenes
VWTKPNKIEGAQKISALSTY

SEQ ID NO: 4301 - protein, 17 aa, Mus sp.
RDLKWGTPVPLEGFEDK

SEQ ID NO: 4302 - protein, 20 aa, Mus sp.
LLPLGEPTAVYKVRTPSAAT

SEQ ID NO: 4303 - protein, 17 aa, Mus sp.
GLDSQGCFCAGCSRQIG

SEQ ID NO: 4304 - protein, 15 aa, Mus sp.
YPDSWSTPHSYFSLK

SEQ ID NO: 4305 - protein, 15 aa, Mus sp.
NYEYYASHVPESVKN

SEQ ID NO: 4306 - protein, 14 aa, Mus sp.
EDFYGSPIPSVSLK

SEQ ID NO: 4307 - protein, 15 aa, Mus sp.
GALLLNAPVVSITQG

SEQ ID NO: 4308 - protein, 18 aa, Mus sp.
IPKVVKSPSSLPAKPLVP

SEQ ID NO: 4309 - protein, 18 aa, Mus sp.
SPPPYAAYATPTPEVYGY

SEQ ID NO: 4310 - protein, 13 aa, Mus sp.
YTIPFYTPIPNGL

SEQ ID NO: 4311 - protein, 15 aa, Mus sp.
DIYVWRGAQATLSNT

SEQ ID NO: 4312 - protein, 16 aa, Mus sp.
TGMAFRVPTPNVSVVD

SEQ ID NO: 4313 - protein, 16 aa, Mus sp.
VPSVIYTHPEVAWVGK

SEQ ID NO: 4314 - protein, 14 aa, Mus sp.
GGDPFAAPQVVPAF

SEQ ID NO: 4315 - protein, 22 aa, Listeria monocytogenes
APGAELIYGHKAASREEFATWA

SEQ ID NO: 4316 - protein, 14 aa, Mus sp.
SEVYTFPVPERHLE

SEQ ID NO: 4317 - protein, 15 aa, Mus sp.
FDIFYTAPQPGKYVI

SEQ ID NO: 4318 - protein, 20 aa, Mus sp.
EPPQVPAEAPQPRASEDSPR

SEQ ID NO: 4319 - protein, 16 aa, Mus sp.
MYQMYGGPVVLVAHSM

SEQ ID NO: 4320 - protein, 19 aa, Mus sp.
APSEERVYMVGKANSVFED

SEQ ID NO: 4321 - protein, 15 aa, Mus sp.
SIPDYWDPAALPDLG

SEQ ID NO: 4322 - protein, 18 aa, Mus sp.
IGDTIEFRGPNGLLVYQG

SEQ ID NO: 4323 - protein, 23 aa, Mus sp.
KPTVTVVSPLPNDSINPQPSPDG

SEQ ID NO: 4324 - protein, 14 aa, Mus sp.
TPEYLAPEIILSKG

SEQ ID NO: 4325 - protein, 18 aa, Mus sp.
AARDNMFSGSKINYTENR

SEQ ID NO: 4326 - protein, 13 aa, Mus sp.
EEEKAPEVSPAQP

SEQ ID NO: 4327 - protein, 15 aa, Mus sp.
ALLLNAPVVSITQGR

SEQ ID NO: 4328 - protein, 14 aa, Mus sp.
RTVITPDPNLSIDQ

SEQ ID NO: 4329 - protein, 20 aa, Mus sp.
APSNYLNNPYVRKALHIPES

SEQ ID NO: 4330 - protein, 21 aa, Mus sp.
IKVPDVDISSPGINVEAPDIH

SEQ ID NO: 4331 - protein, 13 aa, Mus sp.
RYMAPEVLESRMN

SEQ ID NO: 4332 - protein, 17 aa, Mus sp.
EDPDGFSWPATLPSVYK

SEQ ID NO: 4333 - protein, 22 aa, Mus sp.
AIEDDSGRETDSSSAPAVTPSK

SEQ ID NO: 4334 - protein, 16 aa, Mus sp.
DPTNPFRFPNIGVEKF

SEQ ID NO: 4335 - protein, 14 aa, Mus sp.
TPYYVAPEVLGPEK

SEQ ID NO: 4336 - protein, 16 aa, Mus sp.
TIQWWNMPSPNVDPYD

SEQ ID NO: 4337 - protein, 16 aa, Mus sp.
SIASFKDPKISTSLPV

SEQ ID NO: 4338 - protein, 21 aa, Listeria monocytogenes
AVDDTTVKFTLPTVAPAFENT

SEQ ID NO: 4339 - protein, 15 aa, Mus sp.
ELDQLFSGPLPGRLP

SEQ ID NO: 4340 - protein, 15 aa, Mus sp.
VDVFYSSGIPATARP

SEQ ID NO: 4341 - protein, 17 aa, Mus sp.
FPTLKFFPASADRTVID

SEQ ID NO: 4342 - protein, 8 aa, Mus sp.
VNIEFKDL

SEQ ID NO: 4343 - protein, 26 aa, Listeria monocytogenes
ADFRYVFDTAKATAASSYPGSDETPP

SEQ ID NO: 4344 - protein, 16 aa, Mus sp.
WKQKYEETHAELEASQ

SEQ ID NO: 4345 - protein, 12 aa, Mus sp.
VLAPQVVLSLGG

SEQ ID NO: 4346 - protein, 18 aa, Mus sp.
NPTDEYLDAMMNEAPGPI

SEQ ID NO: 4347 - protein, 14 aa, Mus sp.
GPTYRGPVPWHTIN

SEQ ID NO: 4348 - protein, 16 aa, Mus sp.
LALPYDTPVPGYMNNT

SEQ ID NO: 4349 - protein, 15 aa, Mus sp.
ITGVDFIGSTVGLAK

SEQ ID NO: 4350 - protein, 13 aa, Mus sp.
RSNEFDYPSVGQL

SEQ ID NO: 4351 - protein, 15 aa, Mus sp.
EVNSQYQEPDIIIHF

SEQ ID NO: 4352 - protein, 15 aa, Listeria monocytogenes
GINQAYTGSTALSDG

SEQ ID NO: 4353 - protein, 16 aa, Mus sp.
LPETFRRPQIDPAVEG

SEQ ID NO: 4354 - protein, 12 aa, Mus sp.
LPYDTPVPGYMN

SEQ ID NO: 4355 - protein, 14 aa, Mus sp.
GDLSWHPALTTKSK

SEQ ID NO: 4356 - protein, 16 aa, Mus sp.
EGNTWLTAFVLKSFAQ

SEQ ID NO: 4357 - protein, 16 aa, Mus sp.
ENPIYKSAVTTVVNPK

SEQ ID NO: 4358 - protein, 13 aa, Mus sp.
LGEFDTPEAIWSS

SEQ ID NO: 4359 - protein, 15 aa, Mus sp.
REVSSVEAPSVSPAR

SEQ ID NO: 4360 - protein, 14 aa, Mus sp.
TIPFYTPIPNGLYP

SEQ ID NO: 4361 - protein, 15 aa, Mus sp.
LRIINEPTAAAIAYG

SEQ ID NO: 4362 - protein, 18 aa, Mus sp.
LPKPIIWAEPGSVIAAYT

SEQ ID NO: 4363 - protein, 14 aa, Mus sp.
AVLEQEPIVLPAWD

SEQ ID NO: 4364 - protein, 16 aa, Mus sp.
GDSYRSPWSNKYDPPL

SEQ ID NO: 4365 - protein, 17 aa, Mus sp.
EPTTLFKTASALRSSAP

SEQ ID NO: 4366 - protein, 18 aa, Mus sp.
YPYPTDFLGPLPANPVKV

SEQ ID NO: 4367 - protein, 15 aa, Mus sp.
RAAFYHQPWAQEAVG

SEQ ID NO: 4368 - protein, 16 aa, Mus sp.
EVLDYSTPTTNGTPEA

SEQ ID NO: 4369 - protein, 15 aa, Mus sp.
YTWSSRGPSADGALG

SEQ ID NO: 4370 - protein, 17 aa, Mus sp.
SMPDYKPSFPKWARQDF

SEQ ID NO: 4371 - protein, 15 aa, Mus sp.
ANPDFTQPISEVVDE

SEQ ID NO: 4372 - protein, 15 aa, Mus sp.
EKQGFHSGTPAASFN

SEQ ID NO: 4373 - protein, 14 aa, Mus sp.
VEYHFLSPYVSPRE

SEQ ID NO: 4374 - protein, 15 aa, Mus sp.
MAPYQGPDAAPGALD

SEQ ID NO: 4375 - protein, 14 aa, Mus sp.
LPDYTSPVVLPYSR

SEQ ID NO: 4376 - protein, 16 aa, Mus sp.
AQLNYWSAKSLWAKLD

SEQ ID NO: 4377 - protein, 15 aa, Mus sp.
LDQLFSGPLPGRLPV

SEQ ID NO: 4378 - protein, 11 aa, Mus sp.
KYSVWIGGSIL

SEQ ID NO: 4379 - protein, 17 aa, Mus sp.
GDLSQHATPLPTPAVLP

SEQ ID NO: 4380 - protein, 16 aa, Mus sp.
LNLDWQYPGSRGSPPK

SEQ ID NO: 4381 - protein, 17 aa, Mus sp.
GGYGTLQHGEDTVPQGP

SEQ ID NO: 4382 - protein, 17 aa, Mus sp.
NNQAYHSPATALAIVDN

SEQ ID NO: 4383 - protein, 15 aa, Mus sp.
AVKSKYKASIAALEA

SEQ ID NO: 4384 - protein, 16 aa, Mus sp.
DDNVFVPPESLQEEDE

SEQ ID NO: 4385 - protein, 13 aa, Mus sp.
SIASFKDPKISTS

SEQ ID NO: 4386 - protein, 17 aa, Mus sp.
GKKVIYSQPSTRSEGEF

SEQ ID NO: 4387 - protein, 16 aa, Mus sp.
QNAWFLPAQADIVATK

SEQ ID NO: 4388 - protein, 12 aa, Mus sp.
LDYYDSPSVNAR

SEQ ID NO: 4389 - protein, 18 aa, Listeria monocytogenes
VDDTTVKFTLPTVAPAFE

SEQ ID NO: 4390 - protein, 14 aa, Mus sp.
YASWAANQINRAYQ

SEQ ID NO: 4391 - protein, 16 aa, Mus sp.
RNRYWGTPIPLWVSED

SEQ ID NO: 4392 - protein, 15 aa, Mus sp.
SSIASFKDPKISTSL

SEQ ID NO: 4393 - protein, 24 aa, Mus sp.
LDSLIGDSNFGAPSASVAAAPAPA

SEQ ID NO: 4394 - protein, 18 aa, Mus sp.
FKKWVNTPFTASSIELVP

SEQ ID NO: 4395 - protein, 20 aa, Mus sp.
YPRDISNYGFPRSVQAIDAA

SEQ ID NO: 4396 - protein, 18 aa, Mus sp.
SGPKPFSAPKPQTSPSPK

SEQ ID NO: 4397 - protein, 16 aa, Mus sp.
VLIPYQGPSSDYVVVK

SEQ ID NO: 4398 - protein, 20 aa, Mus sp.
EPSKLKRSYSSPDITQALQE

SEQ ID NO: 4399 - protein, 14 aa, Mus sp.
ALMYNTPRAATIIA

SEQ ID NO: 4400 - protein, 19 aa, Mus sp.
EDYVELPPSVSQAAKSPPG

SEQ ID NO: 4401 - protein, 20 aa, Mus sp.
AQPTGPPPYHESLAGASQPP

SEQ ID NO: 4402 - protein, 16 aa, Mus sp.
APMYYRGAQAAIVVYD

SEQ ID NO: 4403 - protein, 15 aa, Mus sp.
SLQAFSNPSAGISVD

SEQ ID NO: 4404 - protein, 14 aa, Mus sp.
LPYTASSGLMAPRE

SEQ ID NO: 4405 - protein, 14 aa, Mus sp.
NVTELNEPLSNEER

SEQ ID NO: 4406 - protein, 18 aa, Mus sp.
TGVPTVPLLPPQVNQSLA

SEQ ID NO: 4407 - protein, 14 aa, Mus sp.
ASLGWIGSIVSTAL

SEQ ID NO: 4408 - protein, 19 aa, Mus sp.
SPPPGGYGQPSVLPGGYPA

SEQ ID NO: 4409 - protein, 23 aa, Mus sp.
APAATDEAAASAAPAASPEPQPE

SEQ ID NO: 4410 - protein, 25 aa, Mus sp.
NVDPFKAVDTNRASMGQASPESKGF

SEQ ID NO: 4411 - protein, 16 aa, Mus sp.
VPTDKYYGAQTVRSTM

SEQ ID NO: 4412 - protein, 18 aa, Mus sp.
DTDRQVWSGSKAAGAPPK

SEQ ID NO: 4413 - protein, 14 aa, Mus sp.
AIVEYHGPGVDSIS

SEQ ID NO: 4414 - protein, 15 aa, Mus sp.
YLNEYGAPDAGGLEH

SEQ ID NO: 4415 - protein, 16 aa, Mus sp.
LPSTWSDPSVNISLDN

SEQ ID NO: 4416 - protein, 20 aa, Mus sp.
RKGEQIYYAGPVNNPGLDVP

SEQ ID NO: 4417 - protein, 13 aa, Mus sp.
KSKYKASIAALEA

SEQ ID NO: 4418 - protein, 15 aa, Mus sp.
DSPDVVYSPETIEAR

SEQ ID NO: 4419 - protein, 17 aa, Mus sp.
INPDNVATPIAASLGDL

SEQ ID NO: 4420 - protein, 17 aa, Mus sp.
IWRDYVPPTANLDQKDK

SEQ ID NO: 4421 - protein, 14 aa, Mus sp.
YKPFQNPVPNQSPS

SEQ ID NO: 4422 - protein, 19 aa, Mus sp.
DGELTYENVQVSPVPGGPP

SEQ ID NO: 4423 - protein, 18 aa, Mus sp.
TGMAFRVPTPNVSVVDLT

SEQ ID NO: 4424 - protein, 24 aa, Mus sp.
NVDPFKAVDTNRASMGQASPESKG

SEQ ID NO: 4425 - protein, 17 aa, Mus sp.
MPDMHFKTPKISMPDID

SEQ ID NO: 4426 - protein, 14 aa, Mus sp.
KDLYYAAPLSIWWQ

SEQ ID NO: 4427 - protein, 14 aa, Mus sp.
LDYWTYPGSLTTPP

SEQ ID NO: 4428 - protein, 14 aa, Mus sp.
DHVDFSQPEPHTVL

SEQ ID NO: 4429 - protein, 16 aa, Mus sp.
YPHIVVGALAASAPIW

SEQ ID NO: 4430 - protein, 15 aa, Mus sp.
SPNYAAPEVISGRLY

SEQ ID NO: 4431 - protein, 18 aa, Mus sp.
INRLDNYDAPDIANIAIS

SEQ ID NO: 4432 - protein, 16 aa, Mus sp.
TRSQVTPSVPSEALDD

SEQ ID NO: 4433 - protein, 18 aa, Mus sp.
AQPPEYTFPSGSGAHFPQ

SEQ ID NO: 4434 - protein, 16 aa, Mus sp.
LDSQYRASAPNSHVPL

SEQ ID NO: 4435 - protein, 13 aa, Mus sp.
NERFRCPEAIFQP

SEQ ID NO: 4436 - protein, 14 aa, Mus sp.
LQPSGQLVSPRPAG

SEQ ID NO: 4437 - protein, 17 aa, Mus sp.
SPDVVYSPETIEARYEY

SEQ ID NO: 4438 - protein, 18 aa, Mus sp.
VHKAFVEVNEEGTEAAAA

SEQ ID NO: 4439 - protein, 19 aa, Mus sp.
AGEVKAFFESHPAPSAERT

SEQ ID NO: 4440 - protein, 13 aa, Mus sp.
FDFAGPAIHGSAV

SEQ ID NO: 4441 - protein, 16 aa, Mus sp.
HIEVWERPLSNLAWAV

SEQ ID NO: 4442 - protein, 17 aa, Mus sp.
NNQDFRGSAGAPSVENV

SEQ ID NO: 4443 - protein, 23 aa, Mus sp.
GPDGKGMNPPSYYTQPVPVPNAN

SEQ ID NO: 4444 - protein, 11 aa, Mus sp.
TLVTYVPVTTF

SEQ ID NO: 4445 - protein, 8 aa, Mus sp.
ITGYFPSM

SEQ ID NO: 4446 - protein, 10 aa, Mus sp.
FVAPAVTPVK

SEQ ID NO: 4447 - protein, 14 aa, Mus sp.
YLPYKSPGINVDSS

SEQ ID NO: 4448 - protein, 16 aa, Mus sp.
LRYNITHPVVNDADAS

SEQ ID NO: 4449 - protein, 18 aa, Mus sp.
EPPSDLDFFSPRPVPAAS

SEQ ID NO: 4450 - protein, 17 aa, Mus sp.
LDLLQQRAPVPASTSVL

SEQ ID NO: 4451 - protein, 15 aa, BOVIN
VVVGPSVVAVPLPLH

SEQ ID NO: 4452 - protein, 16 aa, Mus sp.
LITGVDFIGSTVGLAK

SEQ ID NO: 4453 - protein, 16 aa, Mus sp.
TVDVVLTPLVAEALDR

SEQ ID NO: 4454 - protein, 18 aa, Mus sp.
TKNLDYVATSIHEAVTKI

SEQ ID NO: 4455 - protein, 26 aa, Mus sp.
YPPPPQSDSASSPSPSFSEDNLPPPP

SEQ ID NO: 4456 - protein, 17 aa, Mus sp.
YAVDIRSPAISWVNNLE

SEQ ID NO: 4457 - protein, 18 aa, Mus sp.
KPDSLMGAPSAMVSFYPD

SEQ ID NO: 4458 - protein, 14 aa, Mus sp.
DSYRSPWSNKYDPP

SEQ ID NO: 4459 - protein, 13 aa, Mus sp.
DLLYSFPVVIKNK

SEQ ID NO: 4460 - protein, 17 aa, Mus sp.
ARQNFTEPTAIQAQGWP

SEQ ID NO: 4461 - protein, 17 aa, Mus sp.
YVELPPSVSQAAKSPPG

SEQ ID NO: 4462 - protein, 18 aa, Mus sp.
NKPEDYQGGRTGEAIVDA

SEQ ID NO: 4463 - protein, 17 aa, Mus sp.
DFLKKWETPSQNTAQLD

SEQ ID NO: 4464 - protein, 17 aa, Mus sp.
APQQAAAPEPTSAFNPR

SEQ ID NO: 4465 - protein, 11 aa, Mus sp.
LEVVKKDYDAL

SEQ ID NO: 4466 - protein, 14 aa, Mus sp.
IASFKDPKISTSLP

SEQ ID NO: 4467 - protein, 15 aa, Mus sp.
GIDPYDQPNAIYIER

SEQ ID NO: 4468 - protein, 11 aa, Mus sp.
TIPFYTPIPNG

SEQ ID NO: 4469 - protein, 17 aa, Mus sp.
KNLDYVATSIHEAVTKI

SEQ ID NO: 4470 - protein, 16 aa, Mus sp.
ANPDFTQPISEVVDEV

SEQ ID NO: 4471 - protein, 17 aa, Mus sp.
ARMAPYQGPDAAPGALD

SEQ ID NO: 4472 - protein, 16 aa, Mus sp.
FPDNYNSPTPYKIQYN

SEQ ID NO: 4473 - protein, 23 aa, Mus sp.
LPDLTNIHFPSPLPTPLDPEEPP

SEQ ID NO: 4474 - protein, 17 aa, Mus sp.
MKIYYFAAVAHLHMGKQ

SEQ ID NO: 4475 - protein, 15 aa, Mus sp.
ENDIYNFFSPLNPVR

SEQ ID NO: 4476 - protein, 17 aa, Mus sp.
IDPYDQPNAIYIERHEP

SEQ ID NO: 4477 - protein, 16 aa, Mus sp.
LAVLEQEPIVLPAWDP

SEQ ID NO: 4478 - protein, 14 aa, Mus sp.
KPVPAAPVPSPVAP

SEQ ID NO: 4479 - protein, 17 aa, Mus sp.
FAISYVAALPAAALWHK

SEQ ID NO: 4480 - protein, 19 aa, Mus sp.
EGNMHYDTPDIRRFDPVPA

SEQ ID NO: 4481 - protein, 15 aa, Mus sp.
KPPSYNVATTLPSYD

SEQ ID NO: 4482 - protein, 16 aa, Mus sp.
AEPQAEAPAAAASSEQ

SEQ ID NO: 4483 - protein, 14 aa, Mus sp.
DVYKYETSGIGEAR

SEQ ID NO: 4484 - protein, 16 aa, Mus sp.
TKKFRFEEPVVLPDLS

SEQ ID NO: 4485 - protein, 13 aa, Mus sp.
LRDNYRFAHTNIE

SEQ ID NO: 4486 - protein, 17 aa, Mus sp.
ITPSYYTTSDAVISTET

SEQ ID NO: 4487 - protein, 19 aa, Mus sp.
NRDGDSYRSPWSNKYDPPL

SEQ ID NO: 4488 - protein, 10 aa, Mus sp.
IPFYTPIPNG

SEQ ID NO: 4489 - protein, 17 aa, Mus sp.
RDGDSYRSPWSNKYDPP

SEQ ID NO: 4490 - protein, 18 aa, Mus sp.
KPGSDTIKPDVNKSKEYF

SEQ ID NO: 4491 - protein, 14 aa, Mus sp.
IKIAWESPQGQVSR

SEQ ID NO: 4492 - protein, 16 aa, Mus sp.
APMYYRGSAAAIIVYD

SEQ ID NO: 4493 - protein, 9 aa, Mus sp.
LIMVMMEDY

SEQ ID NO: 4494 - protein, 13 aa, Mus sp.
YKPFQNPVPNQSP

SEQ ID NO: 4495 - protein, 15 aa, Mus sp.
RDGDSYRSPWSNKYD

SEQ ID NO: 4496 - protein, 16 aa, Mus sp.
FPLATYAPVISAEKAY

SEQ ID NO: 4497 - protein, 16 aa, Mus sp.
LNVLRIINEPTAAAIA

SEQ ID NO: 4498 - protein, 16 aa, Mus sp.
LLLHWQPPLSHNGVLT

SEQ ID NO: 4499 - protein, 15 aa, Mus sp.
ARQNFTEPTAIQAQG

SEQ ID NO: 4500 - protein, 17 aa, Mus sp.
YAKVELVPPTPAEIPTA

SEQ ID NO: 4501 - protein, 21 aa, Mus sp.
RPHDTSLVSWVGSEPMPEAGL

SEQ ID NO: 4502 - protein, 18 aa, Mus sp.
ITRDLKWGTPVPLEGFED

SEQ ID NO: 4503 - protein, 13 aa, Mus sp.
VEGYEGSAASIST

SEQ ID NO: 4504 - protein, 18 aa, Mus sp.
KPKGQLPDYTSPVVLPYS

SEQ ID NO: 4505 - protein, 17 aa, Mus sp.
LDIYVWRGAQATLSNTT

SEQ ID NO: 4506 - protein, 14 aa, Mus sp.
SSVAFIKPGVNKAE

SEQ ID NO: 4507 - protein, 13 aa, Mus sp.
LPVKWMAPESIFD

SEQ ID NO: 4508 - protein, 17 aa, Mus sp.
ENLYPYLGPSTLRDRPQ

SEQ ID NO: 4509 - protein, 16 aa, Mus sp.
HNTEFKDSTYDLPRSL

SEQ ID NO: 4510 - protein, 14 aa, Mus sp.
REVSSVEAPSVSPA

SEQ ID NO: 4511 - protein, 20 aa, Mus sp.
AGCEEAKLEIMEFVNFLKNP

SEQ ID NO: 4512 - protein, 17 aa, Mus sp.
SADDFFQGTKAALAGGT

SEQ ID NO: 4513 - protein, 17 aa, Mus sp.
EDRRYNPPIIHQGFQDT

SEQ ID NO: 4514 - protein, 17 aa, Mus sp.
NPGDGAFYGPKIDIQIK

SEQ ID NO: 4515 - protein, 14 aa, Mus sp.
VNGKKFTAPHILIA

SEQ ID NO: 4516 - protein, 18 aa, Mus sp.
GEEAGAYDGPRTADGIVS

SEQ ID NO: 4517 - protein, 15 aa, Mus sp.
GYKPFQNPVPNQSPS

SEQ ID NO: 4518 - protein, 19 aa, Mus sp.
APGKKVIYSQPSTRSEGEF

SEQ ID NO: 4519 - protein, 15 aa, Mus sp.
IDWTYRPPSSSRTES

SEQ ID NO: 4520 - protein, 22 aa, Mus sp.
IDLKGIPVYRFVLPANAFASPL

SEQ ID NO: 4521 - protein, 15 aa, Mus sp.
LALMYNTPRAATIIA

SEQ ID NO: 4522 - protein, 14 aa, Mus sp.
IQFNNYQVRYRPEL

SEQ ID NO: 4523 - protein, 22 aa, Mus sp.
QPVRKNKMASNIFGTPEENPPS

SEQ ID NO: 4524 - protein, 12 aa, Mus sp.
ALKPEYVAPLVL

SEQ ID NO: 4525 - protein, 15 aa, Mus sp.
APHVAYMQPKANAPS

SEQ ID NO: 4526 - protein, 15 aa, Mus sp.
KLQMEAPHIIVGTPG

SEQ ID NO: 4527 - protein, 17 aa, Mus sp.
KKWVNTPFTASSIELVP

SEQ ID NO: 4528 - protein, 14 aa, Mus sp.
RTWAWEAVEALESH

SEQ ID NO: 4529 - protein, 16 aa, Mus sp.
LDKEIYYHGEPISVNV

SEQ ID NO: 4530 - protein, 20 aa, Mus sp.
VPTVPLLPPQVNQSLASMPP

SEQ ID NO: 4531 - protein, 17 aa, Mus sp.
WKPGSDTIKPDVNKSKE

SEQ ID NO: 4532 - protein, 14 aa, Mus sp.
YYLPYKSPGINVDS

SEQ ID NO: 4533 - protein, 17 aa, Mus sp.
YVELPPSVSQAATSPPG

SEQ ID NO: 4534 - protein, 13 aa, Mus sp.
GGHKLGLALELEA

SEQ ID NO: 4535 - protein, 19 aa, Mus sp.
GPKPFSAPKPQTSPSPKPA

SEQ ID NO: 4536 - protein, 26 aa, Mus sp.
NPTVEVDLYTAKGLFRAAVPSGASTG

SEQ ID NO: 4537 - protein, 14 aa, Mus sp.
VDFDFAGPAIHGSA

SEQ ID NO: 4538 - protein, 16 aa, Mus sp.
APFDWEGAQASQALLL

SEQ ID NO: 4539 - protein, 18 aa, Mus sp.
AGHFRSPHTTEVVGGAPQ

SEQ ID NO: 4540 - protein, 15 aa, Mus sp.
EVDRYDAPGIAFYPG

SEQ ID NO: 4541 - protein, 15 aa, Mus sp.
EGDIFIGPKAEEHRG

SEQ ID NO: 4542 - protein, 16 aa, Mus sp.
KPIIWAEPGSVIAAYT

SEQ ID NO: 4543 - protein, 18 aa, Mus sp.
AQRAGYKAAIVHNVDSDD

SEQ ID NO: 4544 - protein, 20 aa, Mus sp.
VGAGHFRSPHTTEVVGGAPQ

SEQ ID NO: 4545 - protein, 15 aa, Mus sp.
WDRKMYYASKAMPAE

SEQ ID NO: 4546 - protein, 13 aa, Mus sp.
IYEGYALPHAILR

SEQ ID NO: 4547 - protein, 16 aa, Mus sp.
EKYVTSAPMPEPGAPG

SEQ ID NO: 4548 - protein, 15 aa, Mus sp.
VPAPATTPAPTPAPA

SEQ ID NO: 4549 - protein, 19 aa, Mus sp.
EPPPAYEPPAPAPAPLPPP

SEQ ID NO: 4550 - protein, 20 aa, Mus sp.
DGEEAGAYDGPRTADGIVSH

SEQ ID NO: 4551 - protein, 13 aa, Mus sp.
STTEFEEPRVIDL

SEQ ID NO: 4552 - protein, 16 aa, Mus sp.
GQDHVDFSQPEPHTVL

SEQ ID NO: 4553 - protein, 17 aa, Mus sp.
INPDNVATPIAASFGDL

SEQ ID NO: 4554 - protein, 20 aa, Mus sp.
VDLYTAKGLFRAAVPSGAST

SEQ ID NO: 4555 - protein, 16 aa, Mus sp.
GGDPFAAPQVVPAFAS

SEQ ID NO: 4556 - protein, 13 aa, Mus sp.
GKKFTAPHILIAT

SEQ ID NO: 4557 - protein, 18 aa, Mus sp.
LRKYHLMQFSEVTKAVSE

SEQ ID NO: 4558 - protein, 17 aa, Mus sp.
EVKDYEPPFGSKVREHP

SEQ ID NO: 4559 - protein, 15 aa, Mus sp.
KRLEFEASQVLGTMD

SEQ ID NO: 4560 - protein, 13 aa, Mus sp.
EWKDYKAGFGNLE

SEQ ID NO: 4561 - protein, 18 aa, Mus sp.
DSRTNTAYVGSAILSEET

SEQ ID NO: 4562 - protein, 16 aa, Mus sp.
VDVFYSSGIPATARPY

SEQ ID NO: 4563 - protein, 17 aa, Mus sp.
ARPDDEVGPAVAPGHPL

SEQ ID NO: 4564 - protein, 24 aa, Mus sp.
APAAPAAAEPQAEAPAAAASSEQS

SEQ ID NO: 4565 - protein, 16 aa, Mus sp.
MKVEYHFLSPYVSPRE

SEQ ID NO: 4566 - protein, 10 aa, Mus sp.
LSYIGPSVNK

SEQ ID NO: 4567 - protein, 13 aa, Mus sp.
DAYHFFSPEPLNS

SEQ ID NO: 4568 - protein, 17 aa, BOVIN
SVVVGPSVVAVPLPLHR

SEQ ID NO: 4569 - protein, 13 aa, Mus sp.
SVGGNMTSMQWAA

SEQ ID NO: 4570 - protein, 26 aa, Mus sp.
VDPTPDPNTAYASYPSASVENYQQPP

SEQ ID NO: 4571 - protein, 17 aa, Mus sp.
GPGLDFEGPDAKLSGPN

SEQ ID NO: 4572 - protein, 15 aa, Mus sp.
RSQVTPSVPSEALDD

SEQ ID NO: 4573 - protein, 12 aa, Mus sp.
VQIYHNPTANSF

SEQ ID NO: 4574 - protein, 19 aa, Mus sp.
SPVRFSTETTFLVDKYEIL

SEQ ID NO: 4575 - protein, 18 aa, Mus sp.
LPDSWASGYAVPVVTVVR

SEQ ID NO: 4576 - protein, 18 aa, Mus sp.
LTGMAFRVPTPNVSVVDL

SEQ ID NO: 4577 - protein, 13 aa, Mus sp.
KPFQNPVPNQSPS

SEQ ID NO: 4578 - protein, 17 aa, Mus sp.
TAKGLFRAAVPSGASTG

SEQ ID NO: 4579 - protein, 16 aa, Mus sp.
VLRIINEPTAAAIAYG

SEQ ID NO: 4580 - protein, 16 aa, Mus sp.
TVIHFNNPKVQASLSA

SEQ ID NO: 4581 - protein, 17 aa, Mus sp.
DRKIVYEGPELNHAFGL

SEQ ID NO: 4582 - protein, 16 aa, Mus sp.
FPIKWTAPEAALYGRF

SEQ ID NO: 4583 - protein, 19 aa, Mus sp.
GKLTGMAFRVPTPNVSVVD

SEQ ID NO: 4584 - protein, 13 aa, Mus sp.
DFVAWATGEPNFA

SEQ ID NO: 4585 - protein, 16 aa, Mus sp.
NVDPFKAVDTNRASMG

SEQ ID NO: 4586 - protein, 14 aa, Mus sp.
EDNWSLPNRAVEPQ

SEQ ID NO: 4587 - protein, 16 aa, Mus sp.
IGRTWNDPSVQQDIKF

SEQ ID NO: 4588 - protein, 23 aa, Mus sp.
DPTSVTLKPMEIRTFLASVQWQE

SEQ ID NO: 4589 - protein, 22 aa, Mus sp.
IQEMEKEDRRYNPPIIHQGFQD

SEQ ID NO: 4590 - protein, 18 aa, Mus sp.
APAAATSAPAPAPAPAPA

SEQ ID NO: 4591 - protein, 20 aa, Mus sp.
SSRAVYLSSKLRGVSLQTTG

SEQ ID NO: 4592 - protein, 12 aa, Mus sp.
VVPWSPPQSNWN

SEQ ID NO: 4593 - protein, 15 aa, Mus sp.
VTQFHPPHIEIQMLK

SEQ ID NO: 4594 - protein, 13 aa, Mus sp.
GGHKLGLGLEFQA

SEQ ID NO: 4595 - protein, 18 aa, Mus sp.
NPTDAYLDAMMNEAPGPI

SEQ ID NO: 4596 - protein, 14 aa, Mus sp.
TTVEYLAPWANQID

SEQ ID NO: 4597 - protein, 14 aa, Mus sp.
ITWTWQGPGALKIL

SEQ ID NO: 4598 - protein, 13 aa, Mus sp.
RYMAPEVLEGAIN

SEQ ID NO: 4599 - protein, 13 aa, Mus sp.
LVEYEASAAGLIR

SEQ ID NO: 4600 - protein, 12 aa, Mus sp.
TNPIITPVAQEN

SEQ ID NO: 4601 - protein, 15 aa, Mus sp.
DSYRSPWSNKYDPPL

SEQ ID NO: 4602 - protein, 15 aa, Mus sp.
KFTLQDSRTNTAYVG

SEQ ID NO: 4603 - protein, 11 aa, Mus sp.
RYMAPEVLDET

SEQ ID NO: 4604 - protein, 16 aa, Mus sp.
KPEDYQGGRTGEAIVD

SEQ ID NO: 4605 - protein, 15 aa, Mus sp.
KNNSFYGPEVKIEKG

SEQ ID NO: 4606 - protein, 15 aa, Mus sp.
GSPNYAAPEVISGRL

SEQ ID NO: 4607 - protein, 18 aa, Mus sp.
FHQRFESPDSQASAEQPE

SEQ ID NO: 4608 - protein, 13 aa, Mus sp.
VTYEWAPPVQNQA

SEQ ID NO: 4609 - protein, 13 aa, Mus sp.
LPYKSPGINVDSS

SEQ ID NO: 4610 - protein, 17 aa, Mus sp.
GRFTYQNAAAQPETGPG

SEQ ID NO: 4611 - protein, 13 aa, Mus sp.
PPSYYTQPVPVPN

SEQ ID NO: 4612 - protein, 16 aa, Mus sp.
FPPEFYEHAKALWEDE

SEQ ID NO: 4613 - protein, 16 aa, Mus sp.
REGSYEAAKILLDHFA

SEQ ID NO: 4614 - protein, 18 aa, Mus sp.
DEATRYLAPTILTDVDPN

SEQ ID NO: 4615 - protein, 20 aa, Mus sp.
SPPSTPDSASAPSTTPASPA

SEQ ID NO: 4616 - protein, 16 aa, Mus sp.
SVYTRYHCSLPVPEPS

SEQ ID NO: 4617 - protein, 16 aa, Mus sp.
RPYLNWNGPPASLEEA

SEQ ID NO: 4618 - protein, 11 aa, Mus sp.
VLDFVTPTPLG

SEQ ID NO: 4619 - protein, 17 aa, Mus sp.
VPKHEYTYPYVDSSDFG

SEQ ID NO: 4620 - protein, 14 aa, Mus sp.
GTPEYLAPEIILSK

SEQ ID NO: 4621 - protein, 18 aa, Mus sp.
SGAVIFNFPGTRNEVIPM

SEQ ID NO: 4622 - protein, 16 aa, Mus sp.
VDFDFAGPAIHGSAVF

SEQ ID NO: 4623 - protein, 18 aa, Mus sp.
TPIPQSGSPFPASVQDPG

SEQ ID NO: 4624 - protein, 17 aa, Mus sp.
FPLKEDNWSLPNRAVEP

SEQ ID NO: 4625 - protein, 15 aa, Mus sp.
IGRTWNDPSVQQDIK

SEQ ID NO: 4626 - protein, 25 aa, Mus sp.
FPGPNIGGDTHFDSAEPWTVQNEDL

SEQ ID NO: 4627 - protein, 15 aa, Mus sp.
AEEVYRNSMPASSFQ

SEQ ID NO: 4628 - protein, 15 aa, Mus sp.
SPTGNIFFSPFSISS

SEQ ID NO: 4629 - protein, 14 aa, Mus sp.
TGVDFIGSTVGLAK

SEQ ID NO: 4630 - protein, 16 aa, Mus sp.
LANMISEPRISYGNDA

SEQ ID NO: 4631 - protein, 16 aa, Mus sp.
KFRFEEPVVLPDLSDQ

SEQ ID NO: 4632 - protein, 13 aa, Mus sp.
DIFIGPKAEEHRG

SEQ ID NO: 4633 - protein, 14 aa, Mus sp.
KKNWFGPSPYVEVT

SEQ ID NO: 4634 - protein, 14 aa, Mus sp.
LPYDTPVPGYMNNT

SEQ ID NO: 4635 - protein, 14 aa, Mus sp.
ALPYDTPVPGYMNN

SEQ ID NO: 4636 - protein, 16 aa, Mus sp.
APDTRFVAPGALGNAP

SEQ ID NO: 4637 - protein, 16 aa, Mus sp.
KELEEQLGPVAEETRA

SEQ ID NO: 4638 - protein, 15 aa, Mus sp.
VPPPFAAAAINEAID

SEQ ID NO: 4639 - protein, 17 aa, Mus sp.
KTPESFLGPNAALVDLD

SEQ ID NO: 4640 - protein, 14 aa, Mus sp.
APPHFHFGQTNRTP

SEQ ID NO: 4641 - protein, 17 aa, Mus sp.
VRIDQYQGADAVGLEEK

SEQ ID NO: 4642 - protein, 14 aa, Mus sp.
ATNPIITPVAQENQ

SEQ ID NO: 4643 - protein, 16 aa, Mus sp.
APNLHFHNPNPEIPAL

SEQ ID NO: 4644 - protein, 26 aa, Mus sp.
ITGLDPAGPNFEYAEAPSRLSPDDAD

SEQ ID NO: 4645 - protein, 16 aa, Mus sp.
NLDYWTYPGSLTTPPL

SEQ ID NO: 4646 - protein, 14 aa, Mus sp.
GDLEYQMSTTARAK

SEQ ID NO: 4647 - protein, 13 aa, Mus sp.
YLPYKSPGINVDS

SEQ ID NO: 4648 - protein, 15 aa, Mus sp.
GNHTLFHNPHVNPLP

SEQ ID NO: 4649 - protein, 16 aa, Mus sp.
EQFSYVLPTVHSLEPS

SEQ ID NO: 4650 - protein, 13 aa, Mus sp.
KTQYISPNLNPND

SEQ ID NO: 4651 - protein, 13 aa, Mus sp.
KFPDWSFPSAWVS

SEQ ID NO: 4652 - protein, 14 aa, Mus sp.
VPIYEGYALPHAIL

SEQ ID NO: 4653 - protein, 14 aa, Mus sp.
ISSVTVFYLGQHAM

SEQ ID NO: 4654 - protein, 24 aa, Mus sp.
YTAKGLFRAAVPSGASTGIYEALE

SEQ ID NO: 4655 - protein, 16 aa, Mus sp.
IFNKFKFPAAVVVEDD

SEQ ID NO: 4656 - protein, 24 aa, Mus sp.
EETELDQLFSGPLPGRLPVNHRPF

SEQ ID NO: 4657 - protein, 15 aa, Mus sp.
DRKIVYEGPELNHAF

SEQ ID NO: 4658 - protein, 14 aa, Mus sp.
VEPYEVHNPVPLIV

SEQ ID NO: 4659 - protein, 13 aa, Mus sp.
RYMAPEVLDETIN

SEQ ID NO: 4660 - protein, 16 aa, Mus sp.
DSVVFAGPAGNSVETR

SEQ ID NO: 4661 - protein, 14 aa, Mus sp.
GLPDYSAPNPIKVT

SEQ ID NO: 4662 - protein, 17 aa, Mus sp.
LPNVQVEGPTPNRPRKQ

SEQ ID NO: 4663 - protein, 20 aa, Mus sp.
YPPSGPTYRGPVPWHTINLD

SEQ ID NO: 4664 - protein, 15 aa, Mus sp.
YEERVLPSIVNEVLK

SEQ ID NO: 4665 - protein, 16 aa, Mus sp.
DGQSVQWWHPQGIIGL

SEQ ID NO: 4666 - protein, 17 aa, Mus sp.
VDFVAWATGEPNFANDD

SEQ ID NO: 4667 - protein, 14 aa, Mus sp.
LALPYDTPVPGYMN

SEQ ID NO: 4668 - protein, 16 aa, Mus sp.
SLEDFYGSPIPSVSLK

SEQ ID NO: 4669 - protein, 15 aa, Mus sp.
GIHHWTPPKGHVDPG

SEQ ID NO: 4670 - protein, 16 aa, Mus sp.
ASFKDPKISTSLPVLD

SEQ ID NO: 4671 - protein, 16 aa, Mus sp.
DDARVYHDPSTQEPVT

SEQ ID NO: 4672 - protein, 15 aa, Mus sp.
LNLDWQYPGSRGSPP

SEQ ID NO: 4673 - protein, 14 aa, Mus sp.
APFDWEGAQASQAL

SEQ ID NO: 4674 - protein, 16 aa, Mus sp.
AAEEFKVPAATSAIIT

SEQ ID NO: 4675 - protein, 13 aa, Mus sp.
TNPIITPVAQENQ

SEQ ID NO: 4676 - protein, 18 aa, Mus sp.
EDRRYNPPIIHQGFQDTS

SEQ ID NO: 4677 - protein, 16 aa, Mus sp.
GSLGEYLFERLTLKHD

SEQ ID NO: 4678 - protein, 15 aa, Mus sp.
IARQNFTEPTAIQAQ

SEQ ID NO: 4679 - protein, 15 aa, Mus sp.
TSDIFGSPVTATAPL

SEQ ID NO: 4680 - protein, 18 aa, Listeria monocytogenes
EILLQKPNGERLTSFITL

SEQ ID NO: 4681 - protein, 17 aa, Mus sp.
IEEIEVAPPKAHEVRIK

SEQ ID NO: 4682 - protein, 12 aa, Mus sp.
KIVYEGPELNHA

SEQ ID NO: 4683 - protein, 14 aa, Mus sp.
VRVSYYGPKTSPVQ

SEQ ID NO: 4684 - protein, 15 aa, Mus sp.
DRQVWSGSKAAGAPP

SEQ ID NO: 4685 - protein, 19 aa, Mus sp.
FEDYVELPPSVSQAATSPP

SEQ ID NO: 4686 - protein, 17 aa, Mus sp.
IGNERFRCPEAIFQPSF

SEQ ID NO: 4687 - protein, 19 aa, Mus sp.
RASLEDFYGSPIPSVSLKL

SEQ ID NO: 4688 - protein, 18 aa, Mus sp.
KPTVTVVSPLPNDSINPQ

SEQ ID NO: 4689 - protein, 14 aa, Mus sp.
IDWTYRPPSSSRTE

SEQ ID NO: 4690 - protein, 16 aa, Mus sp.
QLEALVGPEANVGPYG

SEQ ID NO: 4691 - protein, 16 aa, Mus sp.
SSPEFKGSQASLSDSL

SEQ ID NO: 4692 - protein, 14 aa, Mus sp.
EDVTFIGPDTHAIQ

SEQ ID NO: 4693 - protein, 18 aa, Mus sp.
ARDNMFSGSKINYTENRA

SEQ ID NO: 4694 - protein, 17 aa, Mus sp.
KDIDSFVPSKAAPAAAA

SEQ ID NO: 4695 - protein, 23 aa, Mus sp.
YPPPYPPAAFQGPSDHAAYPIPQ

SEQ ID NO: 4696 - protein, 16 aa, Mus sp.
GDTHFDSAEPWTVQNE

SEQ ID NO: 4697 - protein, 20 aa, Mus sp.
KNKPEDYQGGRTGEAIVDAA

SEQ ID NO: 4698 - protein, 15 aa, Mus sp.
EDTVTISGPQAAVNE

SEQ ID NO: 4699 - protein, 21 aa, Mus sp.
DVIIVDSGKIEVEKPFAIAKE

SEQ ID NO: 4700 - protein, 16 aa, Mus sp.
LDAYPVENQGLKLGFN

SEQ ID NO: 4701 - protein, 15 aa, Mus sp.
FSYAVFGPRVASGDL

SEQ ID NO: 4702 - protein, 20 aa, Mus sp.
GADKTVKGPDGLTALEATDN

SEQ ID NO: 4703 - protein, 24 aa, Mus sp.
DSGDGVTHTVPIYEGYALPHAILR

SEQ ID NO: 4704 - protein, 11 aa, Mus sp.
DGDSYRSPWSN

SEQ ID NO: 4705 - protein, 8 aa, Mus sp.
AVYTFETL

SEQ ID NO: 4706 - protein, 16 aa, Mus sp.
LSIQWESSRPLLASIE

SEQ ID NO: 4707 - protein, 25 aa, Mus sp.
APAPAAPAAAEPQAEAPAAAASSEQ

SEQ ID NO: 4708 - protein, 16 aa, Mus sp.
YDMNAANVGWNGSTFA

SEQ ID NO: 4709 - protein, 14 aa, Mus sp.
EGDIFIGPKAEEHR

SEQ ID NO: 4710 - protein, 21 aa, Mus sp.
EKIQASVATNPIITPVAQENQ

SEQ ID NO: 4711 - protein, 18 aa, Mus sp.
LQHGSLFLKTPKIVSSKD

SEQ ID NO: 4712 - protein, 17 aa, Mus sp.
THDLDFRAPHVLVLGSG

SEQ ID NO: 4713 - protein, 19 aa, Mus sp.
KKFGNSEFDPPGPNVATTT

SEQ ID NO: 4714 - protein, 14 aa, Mus sp.
GPPIFNPVANEVYL

SEQ ID NO: 4715 - protein, 12 aa, Mus sp.
GERFEAPEALFQ

SEQ ID NO: 4716 - protein, 15 aa, Mus sp.
WSDAAAPFAGLSTDQ

SEQ ID NO: 4717 - protein, 14 aa, Mus sp.
KSLTIQPDPIVVPG

SEQ ID NO: 4718 - protein, 15 aa, Mus sp.
EGSYEAAKILLDHFA

SEQ ID NO: 4719 - protein, 18 aa, Mus sp.
KVGGERFEAPEALFQPHL

SEQ ID NO: 4720 - protein, 17 aa, Mus sp.
IPSPGLMVFPKPQTALE

SEQ ID NO: 4721 - protein, 15 aa, Mus sp.
AGMAVFTPVINGVGG

SEQ ID NO: 4722 - protein, 13 aa, Mus sp.
LFPQYTAPSILPS

SEQ ID NO: 4723 - protein, 15 aa, Mus sp.
RITPSYVAFTPEGER

SEQ ID NO: 4724 - protein, 13 aa, Mus sp.
ASFKDPKISTSLP

SEQ ID NO: 4725 - protein, 15 aa, Mus sp.
IASFKDPKISTSLPV

SEQ ID NO: 4726 - protein, 15 aa, Mus sp.
GTPEYLAPEVIQSKG

SEQ ID NO: 4727 - protein, 18 aa, Mus sp.
DPKYRTWAWEAVEALESH

SEQ ID NO: 4728 - protein, 17 aa, Mus sp.
SGALLLNAPVVSITQGR

SEQ ID NO: 4729 - protein, 17 aa, Mus sp.
VEPYEVHNPVPLIVGSS

SEQ ID NO: 4730 - protein, 19 aa, Mus sp.
DSRTNTAYVGSAILSEETA

SEQ ID NO: 4731 - protein, 13 aa, Mus sp.
DARSYTAAVANRA

SEQ ID NO: 4732 - protein, 15 aa, Mus sp.
GERFEAPEALFQPHL

SEQ ID NO: 4733 - protein, 21 aa, Mus sp.
EGDTYEYRVSAVNIVGQGKPS

SEQ ID NO: 4734 - protein, 16 aa, Mus sp.
VPIYEGYALPHAILRL

SEQ ID NO: 4735 - protein, 17 aa, Mus sp.
RRTDWEAPTGQPSAPGP

SEQ ID NO: 4736 - protein, 14 aa, Mus sp.
YTIPFYTPIPNGLY

SEQ ID NO: 4737 - protein, 16 aa, Mus sp.
SILWSQPLPSLPGGPP

SEQ ID NO: 4738 - protein, 17 aa, Mus sp.
LDDNVFVPPESLQEEDE

SEQ ID NO: 4739 - protein, 14 aa, Mus sp.
RRYNPPIIHQGFQD

SEQ ID NO: 4740 - protein, 16 aa, Mus sp.
MGRERYNFPNPNPFVE

SEQ ID NO: 4741 - protein, 16 aa, Mus sp.
FELKPRSPQVIPIEEF

SEQ ID NO: 4742 - protein, 13 aa, BOVIN
SVVVGPSVVAVPL

SEQ ID NO: 4743 - protein, 16 aa, Mus sp.
EQFVYSSPHDNKSWEM

SEQ ID NO: 4744 - protein, 16 aa, Mus sp.
DEGERYIAPTVLVDVQ

SEQ ID NO: 4745 - protein, 14 aa, Mus sp.
KQLTYTYPLVYDHK

SEQ ID NO: 4746 - protein, 16 aa, Mus sp.
NINQWTASIVEQSITH

SEQ ID NO: 4747 - protein, 17 aa, Mus sp.
GNMHYDTPDIRRFDPVP

SEQ ID NO: 4748 - protein, 16 aa, Mus sp.
VKQYYEVPIAMKSVFD

SEQ ID NO: 4749 - protein, 17 aa, Mus sp.
SPTSPSYSPTSPSYSPT

SEQ ID NO: 4750 - protein, 18 aa, Mus sp.
FPTLKFFPASADRTVIDY

SEQ ID NO: 4751 - protein, 15 aa, Mus sp.
ATFGVSGGHINPAVS

SEQ ID NO: 4752 - protein, 16 aa, Mus sp.
LSRFTSGVPSFVLDTE

SEQ ID NO: 4753 - protein, 20 aa, Mus sp.
KKVIEDRDHYIPNTLNPVFG

SEQ ID NO: 4754 - protein, 14 aa, Mus sp.
DKEFHAPLIIDENG

SEQ ID NO: 4755 - protein, 26 aa, Mus sp.
TTILYKLKGNQLVDTLPTVGFNVEPL

SEQ ID NO: 4756 - protein, 17 aa, Mus sp.
ELYRPSFVHPGAATVPT

SEQ ID NO: 4757 - protein, 15 aa, Mus sp.
LRDMYSKSSAAMSTY

SEQ ID NO: 4758 - protein, 15 aa, Mus sp.
FPYEGPAPLEAIANG

SEQ ID NO: 4759 - protein, 13 aa, Mus sp.
YPYIPAHITKPKE

SEQ ID NO: 4760 - protein, 11 aa, Mus sp.
YTIPFYTPIPN

SEQ ID NO: 4761 - protein, 15 aa, Mus sp.
FEVQWQSAEPGSTPR

SEQ ID NO: 4762 - protein, 15 aa, Mus sp.
NPPSYYTQPVPVPNA

SEQ ID NO: 4763 - protein, 17 aa, Mus sp.
EWKDYKAGFGNLEREFW

SEQ ID NO: 4764 - protein, 17 aa, Mus sp.
LGFPYEGPAPLEAIANG

SEQ ID NO: 4765 - protein, 16 aa, Mus sp.
GNHTLFHNPHVNPLPT

SEQ ID NO: 4766 - protein, 16 aa, Mus sp.
AGMAVFTPVINGVGGN

SEQ ID NO: 4767 - protein, 16 aa, Listeria monocytogenes
EVEDLNQPLAAHVNYE

SEQ ID NO: 4768 - protein, 17 aa, Mus sp.
DPTTAFQAPDVGQALLQ

SEQ ID NO: 4769 - protein, 16 aa, Mus sp.
GIYEYYEPRLSVLPSP

SEQ ID NO: 4770 - protein, 16 aa, Mus sp.
DFSTFLSPNVLEEVDS

SEQ ID NO: 4771 - protein, 12 aa, Mus sp.
VGAWTGPMGNWA

SEQ ID NO: 4772 - protein, 16 aa, Mus sp.
TLPPVSPPKAALSVDE

SEQ ID NO: 4773 - protein, 15 aa, Mus sp.
MYKVHNPVPLIVGSS

SEQ ID NO: 4774 - protein, 18 aa, Mus sp.
KPSPIYISSYSSPAREQN

SEQ ID NO: 4775 - protein, 19 aa, Mus sp.
RPPGPPPAPQPPSPAPSPP

SEQ ID NO: 4776 - protein, 16 aa, Mus sp.
VPLPGMKWVDNHKGVF

SEQ ID NO: 4777 - protein, 17 aa, Mus sp.
APAPAAAPAAAPAAAPE

SEQ ID NO: 4778 - protein, 25 aa, Mus sp.
KKHVPEEVLAVLEQEPIVLPAWDPM

SEQ ID NO: 4779 - protein, 12 aa, Mus sp.
IAWESPQGQVSR

SEQ ID NO: 4780 - protein, 15 aa, Mus sp.
TNTAYVGSAILSEET

SEQ ID NO: 4781 - protein, 27 aa, Mus sp.
DDIEADHVGTYGISVYQSPGDIGQYTF

SEQ ID NO: 4782 - protein, 17 aa, Mus sp.
NQLEALVGPEANVGPYG

SEQ ID NO: 4783 - protein, 17 aa, Mus sp.
NKPEDYQGGRTGEAIVD

SEQ ID NO: 4784 - protein, 24 aa, Mus sp.
LPEEVGEYRQPSGGSVPVSPGPPS

SEQ ID NO: 4785 - protein, 17 aa, Mus sp.
SYPFDFQGAKIITGQEE

SEQ ID NO: 4786 - protein, 11 aa, Mus sp.
ELDYYDSPSVN

SEQ ID NO: 4787 - protein, 15 aa, Mus sp.
SLFLKTPKIVSSKDY

SEQ ID NO: 4788 - protein, 17 aa, Mus sp.
DSGGFYISPRSTFSSLQ

SEQ ID NO: 4789 - protein, 12 aa, Mus sp.
VDFDFAGPAIHG

SEQ ID NO: 4790 - protein, 22 aa, Mus sp.
DGNHTLFHNPHVNPLPTGYEDE

SEQ ID NO: 4791 - protein, 16 aa, Mus sp.
FKHAVSDPSILDSLDL

SEQ ID NO: 4792 - protein, 24 aa, Mus sp.
DESGFPKPPSYNVATTLPSYDEAE

SEQ ID NO: 4793 - protein, 11 aa, Mus sp.
PKISTSLPVLD

SEQ ID NO: 4794 - protein, 18 aa, Mus sp.
NHIEVWERPLSNLAWAVA

SEQ ID NO: 4795 - protein, 14 aa, Mus sp.
LDIDSAPITARNTG

SEQ ID NO: 4796 - protein, 15 aa, Mus sp.
GNVYIHPTAKVAPSA

SEQ ID NO: 4797 - protein, 13 aa, Mus sp.
LEDFYGSPIPSVS

SEQ ID NO: 4798 - protein, 21 aa, Mus sp.
GPEAPLDELVGAYPNYNEEEE

SEQ ID NO: 4799 - protein, 14 aa, Mus sp.
DQLEWQSNQPWEQA

SEQ ID NO: 4800 - protein, 15 aa, Mus sp.
VKDGYQMAQPVFAPK

SEQ ID NO: 4801 - protein, 17 aa, Mus sp.
DRSAWYMGPVTRQEAQT

SEQ ID NO: 4802 - protein, 17 aa, Mus sp.
TPQSPTYTPSSPSYSPS

SEQ ID NO: 4803 - protein, 16 aa, Mus sp.
QGGVYASPSIAGSRPG

SEQ ID NO: 4804 - protein, 16 aa, Mus sp.
VLPTYDASKVTASGPG

SEQ ID NO: 4805 - protein, 16 aa, Mus sp.
GPEVDVSLPKANIDVS

SEQ ID NO: 4806 - protein, 15 aa, Mus sp.
YTPYYVAPEVLGPEK

SEQ ID NO: 4807 - protein, 14 aa, Mus sp.
YLNEYGAPDAGGLE

SEQ ID NO: 4808 - protein, 20 aa, Mus sp.
REPPPAYEPPAPAPAPLPPP

SEQ ID NO: 4809 - protein, 14 aa, Mus sp.
GAFTYYGVSALTAP

SEQ ID NO: 4810 - protein, 16 aa, Mus sp.
GPGDGYGYPRAQHVLS

SEQ ID NO: 4811 - protein, 19 aa, Mus sp.
GGDTHFDSAEPWTVQNEDL

SEQ ID NO: 4812 - protein, 17 aa, BOVIN
GPPVASVVVGPSVVAVP

SEQ ID NO: 4813 - protein, 13 aa, Mus sp.
IVKYNASLVTPEM

SEQ ID NO: 4814 - protein, 21 aa, Mus sp.
SNKIPEVDMARVVAPFMSNIP

SEQ ID NO: 4815 - protein, 26 aa, Mus sp.
GNPTVEVDLYTAKGLFRAAVPSGAST

SEQ ID NO: 4816 - protein, 18 aa, Mus sp.
IPITYPTTAPEIAVPELD

SEQ ID NO: 4817 - protein, 23 aa, Mus sp.
TPSPESPDQWSSSSPHSASDWSD

SEQ ID NO: 4818 - protein, 16 aa, Mus sp.
YVELPPSVSQAATSPP

SEQ ID NO: 4819 - protein, 19 aa, Mus sp.
AGPNFEYAEAPSRLSPDDA

SEQ ID NO: 4820 - protein, 18 aa, Mus sp.
EETELDQLFSGPLPGRLP

SEQ ID NO: 4821 - protein, 19 aa, Mus sp.
KAHAFSVEALIGAEKQQQL

SEQ ID NO: 4822 - protein, 13 aa, Mus sp.
KNLDYVATSIHEA

SEQ ID NO: 4823 - protein, 17 aa, Mus sp.
LAVLEQEPIVLPAWDPM

SEQ ID NO: 4824 - protein, 15 aa, Mus sp.
GIPVYRFVLPANAFA

SEQ ID NO: 4825 - protein, 19 aa, Mus sp.
ALEDPDGFSWPATLPSVYK

SEQ ID NO: 4826 - protein, 17 aa, Mus sp.
GGSPYIAAKINEAKDLL

SEQ ID NO: 4827 - protein, 17 aa, Mus sp.
GIPVYRFVLPANAFASP

SEQ ID NO: 4828 - protein, 17 aa, Mus sp.
DPQLSYAVSWAKVSESG

SEQ ID NO: 4829 - protein, 18 aa, Mus sp.
FHKAFLEVNEEGSEAAAS

SEQ ID NO: 4830 - protein, 16 aa, Mus sp.
AGEFDYSGSQAIKALK

SEQ ID NO: 4831 - protein, 23 aa, Mus sp.
ASFDPQGGLQNIAVVKHNLGVLT

SEQ ID NO: 4832 - protein, 15 aa, Mus sp.
SFVDYQTTMVRTAKA

SEQ ID NO: 4833 - protein, 17 aa, Mus sp.
CFPPSERFMKYLLNFIS

SEQ ID NO: 4834 - protein, 19 aa, Mus sp.
NFKKWVNTPFTASSIELVP

SEQ ID NO: 4835 - protein, 18 aa, Mus sp.
DEAQVEFMASHGNEAARA

SEQ ID NO: 4836 - protein, 17 aa, Mus sp.
DVRAVAHSPTALISGGT

SEQ ID NO: 4837 - protein, 16 aa, Mus sp.
IDWTYRPPSSSRTESI

SEQ ID NO: 4838 - protein, 15 aa, Mus sp.
KPSTFAYPAPLEVPK

SEQ ID NO: 4839 - protein, 16 aa, Mus sp.
KKVIYSQPSTRSEGEF

SEQ ID NO: 4840 - protein, 14 aa, Mus sp.
GPPPGWEGPHPQRG

SEQ ID NO: 4841 - protein, 18 aa, Mus sp.
GEQIYYAGPVNNPGLDVP

SEQ ID NO: 4842 - protein, 16 aa, Mus sp.
RVSSWDVPTVVPVPFE

SEQ ID NO: 4843 - protein, 18 aa, Mus sp.
GPEPGPYAQPSVNTPLPN

SEQ ID NO: 4844 - protein, 17 aa, Mus sp.
YPTPAYTIPFYTPIPNG

SEQ ID NO: 4845 - protein, 18 aa, Mus sp.
APAPEFTAAQPEVADWSE

SEQ ID NO: 4846 - protein, 12 aa, Mus sp.
WTISPVPQSIVD

SEQ ID NO: 4847 - protein, 15 aa, Mus sp.
EDNVFEAPTLVKVFK

SEQ ID NO: 4848 - protein, 18 aa, Mus sp.
KHWGEWSPAHPLEAEDTR

SEQ ID NO: 4849 - protein, 17 aa, Mus sp.
SPYAFNGGTVLAIAGED

SEQ ID NO: 4850 - protein, 16 aa, Mus sp.
DPWTAWNAPKPGNWDS

SEQ ID NO: 4851 - protein, 15 aa, Mus sp.
LAVLEQEPIVLPAWD

SEQ ID NO: 4852 - protein, 14 aa, Mus sp.
GKKFTAPHILIATG

SEQ ID NO: 4853 - protein, 18 aa, Mus sp.
SPTGNIFFSPFSISSALA

SEQ ID NO: 4854 - protein, 17 aa, Mus sp.
SKPSFHAPEPKPHYDPA

SEQ ID NO: 4855 - protein, 22 aa, Listeria monocytogenes
YVFDTAKATAASSYPGSDETPP

SEQ ID NO: 4856 - protein, 15 aa, Mus sp.
KWKYEKPDGSPVFIA

SEQ ID NO: 4857 - protein, 27 aa, Mus sp.
GGLDSLIGDSNFGAPSASVAAAPAPAR

SEQ ID NO: 4858 - protein, 15 aa, Mus sp.
GYPTAYPAAAPAYNP

SEQ ID NO: 4859 - protein, 14 aa, Mus sp.
NQLEALVGPEANVG

SEQ ID NO: 4860 - protein, 18 aa, Mus sp.
GTDRKIVYEGPELNHAFG

SEQ ID NO: 4861 - protein, 14 aa, Mus sp.
KGPAFVNPLIPENK

SEQ ID NO: 4862 - protein, 12 aa, Mus sp.
RYMAPEVLESRM

SEQ ID NO: 4863 - protein, 14 aa, Mus sp.
AGGHKVGLGFELEA

SEQ ID NO: 4864 - protein, 17 aa, Mus sp.
ELDQLFSGPLPGRLPVN

SEQ ID NO: 4865 - protein, 17 aa, Mus sp.
VPIYEGYALPHAILRLD

SEQ ID NO: 4866 - protein, 17 aa, Mus sp.
IPEAQWQSSLARTSSAE

SEQ ID NO: 4867 - protein, 17 aa, Mus sp.
TKKFRFEEPVVLPDLSD

SEQ ID NO: 4868 - protein, 14 aa, Mus sp.
FYVDLDKKETVWML

SEQ ID NO: 4869 - protein, 18 aa, Mus sp.
GPVPEFSGATVERVSEDM

SEQ ID NO: 4870 - protein, 18 aa, Mus sp.
DPGVPSEWTSPASAGSSD

SEQ ID NO: 4871 - protein, 12 aa, Mus sp.
RLNSPVTIPAVM

SEQ ID NO: 4872 - protein, 18 aa, Mus sp.
GQDHVDFSQPEPHTVLFH

SEQ ID NO: 4873 - protein, 18 aa, Listeria monocytogenes
DDTTVKFTLPTVAPAFEN

SEQ ID NO: 4874 - protein, 17 aa, Mus sp.
MYQMYGGPVVLVAHSMG

SEQ ID NO: 4875 - protein, 18 aa, Mus sp.
NRDGDSYRSPWSNKYDPP

SEQ ID NO: 4876 - protein, 17 aa, Mus sp.
DRNRPYVFSAPSESVEL

SEQ ID NO: 4877 - protein, 19 aa, Mus sp.
TPRVLSQAPSPLYSVEFSE

SEQ ID NO: 4878 - protein, 22 aa, Mus sp.
GGDPEAPAPAPAAERPPAPGPG

SEQ ID NO: 4879 - protein, 20 aa, Mus sp.
DEGERYIAPTVLVDVQETEP

SEQ ID NO: 4880 - protein, 15 aa, Mus sp.
LPSTSYLPSTPSVVP

SEQ ID NO: 4881 - protein, 16 aa, Mus sp.
VNGKKFTAPHILIATG

SEQ ID NO: 4882 - protein, 19 aa, Mus sp.
LPPYDDATAVPSTAKEPPP

SEQ ID NO: 4883 - protein, 18 aa, Mus sp.
APGGYPAAGPYGVPAGPL

SEQ ID NO: 4884 - protein, 18 aa, Mus sp.
DYVELPPSVSQAAKSPPG

SEQ ID NO: 4885 - protein, 15 aa, Mus sp.
YPFDFQGAKIITGQE

SEQ ID NO: 4886 - protein, 17 aa, Mus sp.
LPFGAYTNPFATPAQAQ

SEQ ID NO: 4887 - protein, 15 aa, Mus sp.
VGTKRYMAPEVLDDS

SEQ ID NO: 4888 - protein, 19 aa, Mus sp.
LPTELSNTYTFPNPAHPPG

SEQ ID NO: 4889 - protein, 13 aa, Mus sp.
LRDWESPYSHDLD

SEQ ID NO: 4890 - protein, 16 aa, Mus sp.
LPKEWLTPAALQSSVS

SEQ ID NO: 4891 - protein, 14 aa, Mus sp.
VDQIYHLASPASPP

SEQ ID NO: 4892 - protein, 18 aa, Mus sp.
EEKPVPAAPVPSPVAPAP

SEQ ID NO: 4893 - protein, 15 aa, Mus sp.
IGDESVGRVVFGLFG

SEQ ID NO: 4894 - protein, 16 aa, Mus sp.
VFPEFAAAHSNLASVL

SEQ ID NO: 4895 - protein, 16 aa, Mus sp.
NPLNSVFVAPAVTPVK

SEQ ID NO: 4896 - protein, 13 aa, Mus sp.
MYKVHNPVPLIVG

SEQ ID NO: 4897 - protein, 17 aa, Mus sp.
GNNCKNGGACVDGVNTY

SEQ ID NO: 4898 - protein, 18 aa, Mus sp.
GPAGPGAVEGPNPASSPD

SEQ ID NO: 4899 - protein, 22 aa, Mus sp.
TPARAPETRSQVTPSVPSEALD

SEQ ID NO: 4900 - protein, 13 aa, Listeria monocytogenes
WNEKYAQAYPNVS

SEQ ID NO: 4901 - protein, 16 aa, Mus sp.
SFVNIVERDRTLGYQE

SEQ ID NO: 4902 - protein, 13 aa, Mus sp.
EVQWQSAEPGSTP

SEQ ID NO: 4903 - protein, 15 aa, Mus sp.
GGVYASPSIAGSRPG

SEQ ID NO: 4904 - protein, 20 aa, Mus sp.
TPSPESPDQWSSSSPHSASD

SEQ ID NO: 4905 - protein, 18 aa, Mus sp.
VPIYEGYALPHAILRLDL

SEQ ID NO: 4906 - protein, 14 aa, Mus sp.
APGGYVAPKAVWLP

SEQ ID NO: 4907 - protein, 14 aa, Mus sp.
VLLPFFDPDTNIVY

SEQ ID NO: 4908 - protein, 18 aa, Mus sp.
RLYKKAYNDHKAKISIPV

SEQ ID NO: 4909 - protein, 26 aa, Mus sp.
FPGPNIGGDTHFDSAEPWTVQNEDLN

SEQ ID NO: 4910 - protein, 14 aa, Mus sp.
AYNFDETKDLDLDD

SEQ ID NO: 4911 - protein, 20 aa, Mus sp.
GKLTGMAFRVPTPNVSVVDL

SEQ ID NO: 4912 - protein, 16 aa, Mus sp.
VSTLIWAAPRLQSEVA

SEQ ID NO: 4913 - protein, 14 aa, Mus sp.
AGGHKLGLALELEA

SEQ ID NO: 4914 - protein, 15 aa, Mus sp.
TSSLAAPTVEAAASA

SEQ ID NO: 4915 - protein, 22 aa, Mus sp.
IEKDPAKGRIYQGTEADSIFSG

SEQ ID NO: 4916 - protein, 16 aa, Mus sp.
DAGNAFKKADPQEAIN

SEQ ID NO: 4917 - protein, 17 aa, Mus sp.
KEIEVDSSPSVLEILDT

SEQ ID NO: 4918 - protein, 16 aa, Mus sp.
TQVQWNDPGAQYSLVN

SEQ ID NO: 4919 - protein, 12 aa, Mus sp.
YRGAQAAIVVYD

SEQ ID NO: 4920 - protein, 16 aa, Mus sp.
GTVIHFNNPKVQASLA

SEQ ID NO: 4921 - protein, 13 aa, Mus sp.
APGGYVAPKAVWL

SEQ ID NO: 4922 - protein, 15 aa, Mus sp.
SNLSYREPDPEDAVG

SEQ ID NO: 4923 - protein, 17 aa, Mus sp.
LKRSYSSPDITQALQEE

SEQ ID NO: 4924 - protein, 16 aa, Mus sp.
KKAGYITPVPGGVGPM

SEQ ID NO: 4925 - protein, 15 aa, Mus sp.
SLVQTYVGAISNGSL

SEQ ID NO: 4926 - protein, 18 aa, Mus sp.
APPLPIKTPIPTPSTLPA

SEQ ID NO: 4927 - protein, 17 aa, Mus sp.
ISLPHFLHASPDVSEPI

SEQ ID NO: 4928 - protein, 12 aa, Mus sp.
VNWYAPLVAPIS

SEQ ID NO: 4929 - protein, 17 aa, Mus sp.
AKQIVWNGPVGVFEWEA

SEQ ID NO: 4930 - protein, 16 aa, Mus sp.
TPERLNSPVTIPAVMF

SEQ ID NO: 4931 - protein, 18 aa, Mus sp.
LPGNLDYWTYPGSLTTPP

SEQ ID NO: 4932 - protein, 15 aa, Mus sp.
LKYHFVTPLTSMVVT

SEQ ID NO: 4933 - protein, 24 aa, Mus sp.
EKWEETELDQLFSGPLPGRLPVNH

SEQ ID NO: 4934 - protein, 15 aa, Mus sp.
VDMARVVAPFMSNIP

SEQ ID NO: 4935 - protein, 19 aa, Mus sp.
GVPDDLLYSFPVVIKNKTW

SEQ ID NO: 4936 - protein, 17 aa, Mus sp.
GGDTHFDSAEPWTVQNE

SEQ ID NO: 4937 - protein, 16 aa, Mus sp.
SALEYGMPVTLIGEAV

SEQ ID NO: 4938 - protein, 16 aa, Mus sp.
TVIHFNNPKVQASLAA

SEQ ID NO: 4939 - protein, 19 aa, Mus sp.
DDREDITHTYKYPEGSPEE

SEQ ID NO: 4940 - protein, 13 aa, Mus sp.
EDNVFEAPTLVKV

SEQ ID NO: 4941 - protein, 17 aa, Mus sp.
GTVDVVLTPLVAEALDR

SEQ ID NO: 4942 - protein, 17 aa, Mus sp.
TRSQVTPSVPSEALDDS

SEQ ID NO: 4943 - protein, 15 aa, Mus sp.
EQLEWLSQRANALLA

SEQ ID NO: 4944 - protein, 13 aa, Mus sp.
APFDWEGAQASQA

SEQ ID NO: 4945 - protein, 16 aa, Mus sp.
DKQREEYQPATPGLGM

SEQ ID NO: 4946 - protein, 15 aa, Mus sp.
AVDVFFPPEAQNDFP

SEQ ID NO: 4947 - protein, 18 aa, Mus sp.
IDTAAKFIGAGAATVGVA

SEQ ID NO: 4948 - protein, 20 aa, Mus sp.
SPPHVQFTYQQPQPLSVEPR

SEQ ID NO: 4949 - protein, 16 aa, Mus sp.
KPVPAAPVPSPVAPAP

SEQ ID NO: 4950 - protein, 16 aa, Mus sp.
IDNPDYKGTWIHPEID

SEQ ID NO: 4951 - protein, 16 aa, Mus sp.
QDPTFHTPLDLYAYAR

SEQ ID NO: 4952 - protein, 14 aa, Mus sp.
FTYQQPQPLSVEPR

SEQ ID NO: 4953 - protein, 15 aa, Mus sp.
VPPVFTQPTANIMPS

SEQ ID NO: 4954 - protein, 16 aa, Mus sp.
RNYEYYASHVPESVKN

SEQ ID NO: 4955 - protein, 17 aa, Mus sp.
VAPKETTIWVSPSPILE

SEQ ID NO: 4956 - protein, 17 aa, Mus sp.
LEFIDVHVKLPRFKIEE

SEQ ID NO: 4957 - protein, 14 aa, Mus sp.
TTSSYSNPTIGYEN

SEQ ID NO: 4958 - protein, 18 aa, Mus sp.
WSDAAAPFAGLSTDQTLR

SEQ ID NO: 4959 - protein, 20 aa, Mus sp.
GQDHVDFSQPEPHTVLFHEP

SEQ ID NO: 4960 - protein, 20 aa, Mus sp.
APAATDEAAASAAPAASPEP

SEQ ID NO: 4961 - protein, 16 aa, Mus sp.
TKGNPARWRDFHSATM

SEQ ID NO: 4962 - protein, 15 aa, Mus sp.
EEDTEYMTPTSRPVG

SEQ ID NO: 4963 - protein, 16 aa, Mus sp.
YNPAQQILAYTGLCPP

SEQ ID NO: 4964 - protein, 15 aa, Mus sp.
AVLEQEPIVLPAWDP

SEQ ID NO: 4965 - protein, 16 aa, Mus sp.
FKKWVNTPFTASSIEL

SEQ ID NO: 4966 - protein, 16 aa, Mus sp.
SVPATFAPSPTPAVVS

SEQ ID NO: 4967 - protein, 13 aa, Mus sp.
LDWQYPGSRGSPP

SEQ ID NO: 4968 - protein, 15 aa, Mus sp.
SKEAFQEALAAAGDK

SEQ ID NO: 4969 - protein, 15 aa, Mus sp.
RPHWLEPTIYSSEED

SEQ ID NO: 4970 - protein, 17 aa, Mus sp.
EPPQYPYIPAHITKPKE

SEQ ID NO: 4971 - protein, 18 aa, Mus sp.
DPKLTYHGFTLEDAASPK

SEQ ID NO: 4972 - protein, 15 aa, Mus sp.
EDPDGFSWPATLPSV

SEQ ID NO: 4973 - protein, 15 aa, Mus sp.
EIQDWSASSPHSAAY

SEQ ID NO: 4974 - protein, 17 aa, Mus sp.
LGRPDAEYWNSQPEILE

SEQ ID NO: 4975 - protein, 15 aa, Mus sp.
GDFYYHAAIFGGTPT

SEQ ID NO: 4976 - protein, 18 aa, Mus sp.
TRELWDSPEPASAPRTPQ

SEQ ID NO: 4977 - protein, 15 aa, Mus sp.
EPYMYLSPLQQAVSD

SEQ ID NO: 4978 - protein, 14 aa, Mus sp.
IPYQGPSSDYVVVK

SEQ ID NO: 4979 - protein, 15 aa, Mus sp.
DVDFDFAGPAIHGSA

SEQ ID NO: 4980 - protein, 15 aa, Mus sp.
PDGFSWPATLPSVYK

SEQ ID NO: 4981 - protein, 13 aa, Mus sp.
YVTQFHPPHIEIQ

SEQ ID NO: 4982 - protein, 19 aa, Mus sp.
ETKKFRFEEPVVLPDLSDQ

SEQ ID NO: 4983 - protein, 15 aa, Mus sp.
APFDWEGAQASQALL

SEQ ID NO: 4984 - protein, 15 aa, Mus sp.
RPVQFPYVTPAPHEP

SEQ ID NO: 4985 - protein, 20 aa, Mus sp.
TPSPESPDQWSSSSPHSNIS

SEQ ID NO: 4986 - protein, 15 aa, Mus sp.
TMLSGKDTVQHWNWT

SEQ ID NO: 4987 - protein, 14 aa, Mus sp.
ESKVVVPPLPGKAF

SEQ ID NO: 4988 - protein, 15 aa, Mus sp.
FVEEFIWPAVQSSAL

SEQ ID NO: 4989 - protein, 15 aa, Mus sp.
VQLVEYEASAAGLIR

SEQ ID NO: 4990 - protein, 16 aa, Mus sp.
VRVDEYDYSKPIQGQQ

SEQ ID NO: 4991 - protein, 22 aa, Mus sp.
IDVDPQEDPQNAPDVNYVVENP

SEQ ID NO: 4992 - protein, 15 aa, Mus sp.
EVGEYRQPSGGSVPV

SEQ ID NO: 4993 - protein, 17 aa, BOVIN
PPVASVVVGPSVVAVPL

SEQ ID NO: 4994 - protein, 12 aa, Mus sp.
DNYRFAHTNIES

SEQ ID NO: 4995 - protein, 16 aa, Mus sp.
ISKQEYDESGPSIVHR

SEQ ID NO: 4996 - protein, 21 aa, Mus sp.
DDREDITHTYKYPEGSPEERE

SEQ ID NO: 4997 - protein, 15 aa, Mus sp.
GKPAQYIAVHVVPDQ

SEQ ID NO: 4998 - protein, 16 aa, Mus sp.
PMFIVNTNVPRASVPE

SEQ ID NO: 4999 - protein, 17 aa, Mus sp.
LTVTPWKAPIVWEGTYD

SEQ ID NO: 5000 - protein, 13 aa, Mus sp.
GDIFIGPKAEEHR

SEQ ID NO: 5001 - protein, 15 aa, Mus sp.
GPKVNVEAPNVNMEG

SEQ ID NO: 5002 - protein, 20 aa, Mus sp.
QPTGPPPYHESLAGASQPPY

SEQ ID NO: 5003 - protein, 16 aa, Mus sp.
AVDVFFPPEAQNDFPV

SEQ ID NO: 5004 - protein, 16 aa, Mus sp.
LFPQYTAPSILPSDIT

SEQ ID NO: 5005 - protein, 15 aa, Mus sp.
RERYNFPNPNPFVED

SEQ ID NO: 5006 - protein, 14 aa, Mus sp.
DPDGFSWPATLPSV

SEQ ID NO: 5007 - protein, 17 aa, Mus sp.
SPNKLYTLVTYVPVTTF

SEQ ID NO: 5008 - protein, 16 aa, Mus sp.
ADEPVWRSEQAIGAIA

SEQ ID NO: 5009 - protein, 14 aa, Mus sp.
GQDHVDFSQPEPHT

SEQ ID NO: 5010 - protein, 16 aa, Mus sp.
TPEYLAPEVLEDNDYG

SEQ ID NO: 5011 - protein, 13 aa, Mus sp.
AEQEVLAPQVVLS

SEQ ID NO: 5012 - protein, 18 aa, Mus sp.
VPDDLLYSFPVVIKNKTW

SEQ ID NO: 5013 - protein, 16 aa, Mus sp.
VELPPSVSQAATSPPG

SEQ ID NO: 5014 - protein, 24 aa, Mus sp.
TSPDWAGDMTQGHRSQEELSGPES

SEQ ID NO: 5015 - protein, 17 aa, Mus sp.
EAIETIVAAMSNLVPPV

SEQ ID NO: 5016 - protein, 15 aa, Mus sp.
DVPFTLAPHVLAAQG

SEQ ID NO: 5017 - protein, 19 aa, Listeria monocytogenes
DDTTVKFTLPTVAPAFENT

SEQ ID NO: 5018 - protein, 13 aa, Mus sp.
TVIHFNNPKVQAS

SEQ ID NO: 5019 - protein, 15 aa, Mus sp.
INDIIRAPTIEQMKD

SEQ ID NO: 5020 - protein, 16 aa, Mus sp.
LRQPYYATRVNAADIE

SEQ ID NO: 5021 - protein, 14 aa, Mus sp.
FIVKYELPLVIKAL

SEQ ID NO: 5022 - protein, 16 aa, Mus sp.
LDLLDLAPEPRYAHIP

SEQ ID NO: 5023 - protein, 17 aa, Mus sp.
DMFHYTSTTTKVPPPDT

SEQ ID NO: 5024 - protein, 19 aa, Mus sp.
GPDGRFVMGPTVAPSQEKL

SEQ ID NO: 5025 - protein, 21 aa, Mus sp.
GTPEYIAPEVIFRQGYGKPVD

SEQ ID NO: 5026 - protein, 13 aa, Mus sp.
EVAFNGPKGGYVA

SEQ ID NO: 5027 - protein, 16 aa, Mus sp.
LGFPYEGPAPLEAIAN

SEQ ID NO: 5028 - protein, 21 aa, Mus sp.
DEGKLLEAKGPVTDVAYSHDG

SEQ ID NO: 5029 - protein, 16 aa, Mus sp.
VDRVLKSPVASIVYEL

SEQ ID NO: 5030 - protein, 24 aa, Mus sp.
LYCGGAEDPDVTASAERRLHKSPG

SEQ ID NO: 5031 - protein, 16 aa, Mus sp.
ARDNMFSGSKINYTEN

SEQ ID NO: 5032 - protein, 14 aa, Mus sp.
APTSALGPKASPAP

SEQ ID NO: 5033 - protein, 14 aa, Mus sp.
DFYGSPIPSVSLKL

SEQ ID NO: 5034 - protein, 13 aa, Mus sp.
QEVLAPQVVLSLG

SEQ ID NO: 5035 - protein, 17 aa, Mus sp.
TPAAPTSALGPKASPAP

SEQ ID NO: 5036 - protein, 13 aa, Mus sp.
APDMVYLGSMTNF

SEQ ID NO: 5037 - protein, 16 aa, Mus sp.
AEVEFSAPYPMEVIFE

SEQ ID NO: 5038 - protein, 13 aa, Mus sp.
DVFLGPYVAVFDR

SEQ ID NO: 5039 - protein, 15 aa, Mus sp.
LRDNYRFAHTNIESL

SEQ ID NO: 5040 - protein, 19 aa, Mus sp.
GPAGPGAVEGPNPASSPDA

SEQ ID NO: 5041 - protein, 18 aa, Mus sp.
EPSPVSETVVTPEAAPEK

SEQ ID NO: 5042 - protein, 20 aa, Mus sp.
HPPQEATNSPKPQPSYEELE

SEQ ID NO: 5043 - protein, 25 aa, Mus sp.
KDESGFPKPPSYNVATTLPSYDEAE

SEQ ID NO: 5044 - protein, 14 aa, Mus sp.
TGMAFRVPTPNVSV

SEQ ID NO: 5045 - protein, 19 aa, Mus sp.
TPSPESPDQWSSSSPHSAS

SEQ ID NO: 5046 - protein, 14 aa, Mus sp.
SEEEYSAPLPTPAP

SEQ ID NO: 5047 - protein, 17 aa, Mus sp.
GVPDDLLYSFPVVIKNK

SEQ ID NO: 5048 - protein, 19 aa, Mus sp.
SGPKPFSAPKPQTSPSPKP

SEQ ID NO: 5049 - protein, 16 aa, Mus sp.
DSGGFYISPRSTFSSL

SEQ ID NO: 5050 - protein, 14 aa, Mus sp.
VTPWKAPIVWEGTY

SEQ ID NO: 5051 - protein, 16 aa, Mus sp.
LPANAFASPLQNPDNH

SEQ ID NO: 5052 - protein, 18 aa, Mus sp.
GPRPEEYEFLTPVEEAPK

SEQ ID NO: 5053 - protein, 18 aa, Mus sp.
HPAPPVASSPTVIPGEPR

SEQ ID NO: 5054 - protein, 18 aa, Mus sp.
DGNHTLFHNPHVNPLPTG

SEQ ID NO: 5055 - protein, 14 aa, Mus sp.
GVYASPSIAGSRPG

SEQ ID NO: 5056 - protein, 13 aa, Mus sp.
KFRFEEPVVLPDL

SEQ ID NO: 5057 - protein, 15 aa, Mus sp.
KFIYVDVLPEEAVGP

SEQ ID NO: 5058 - protein, 13 aa, Mus sp.
DVDFDFAGPAIHG

SEQ ID NO: 5059 - protein, 12 aa, Mus sp.
YLPYKSPGINVD

SEQ ID NO: 5060 - protein, 15 aa, Mus sp.
APTSALGPKASPAPS

SEQ ID NO: 5061 - protein, 16 aa, Mus sp.
IPKTKFGKPDPIVSVI

SEQ ID NO: 5062 - protein, 17 aa, Mus sp.
LTPWLAPIVSEGTFDPE

SEQ ID NO: 5063 - protein, 15 aa, Mus sp.
VYIFYGASIASLSAS

SEQ ID NO: 5064 - protein, 16 aa, Mus sp.
YNPEAMVAPSVLSNIQ

SEQ ID NO: 5065 - protein, 19 aa, Mus sp.
MPNPKDNEVNHIRATCFNS

SEQ ID NO: 5066 - protein, 12 aa, Mus sp.
HTLFHNPHVNPL

SEQ ID NO: 5067 - protein, 16 aa, Mus sp.
VPSGLFIPSMAIGAIA

SEQ ID NO: 5068 - protein, 18 aa, Mus sp.
ITGVDFIGSTVGLAKVSA

SEQ ID NO: 5069 - protein, 15 aa, Mus sp.
SELLRSAQPASAEPR

SEQ ID NO: 5070 - protein, 17 aa, Mus sp.
LEEKGVYVQASTLGSLE

SEQ ID NO: 5071 - protein, 18 aa, Mus sp.
FHKLSYLTFIPSDDDIYD

SEQ ID NO: 5072 - protein, 18 aa, Mus sp.
GAEIEYAMAYSKAAFERE

SEQ ID NO: 5073 - protein, 14 aa, Mus sp.
ASPVFRAPGLTAVA

SEQ ID NO: 5074 - protein, 21 aa, Mus sp.
ITVKELFTTPVLRASVSSPFP

SEQ ID NO: 5075 - protein, 14 aa, Mus sp.
INYQPPTVVPGGDL

SEQ ID NO: 5076 - protein, 14 aa, Mus sp.
VPVYLAGAAGLSVG

SEQ ID NO: 5077 - protein, 16 aa, Mus sp.
EVSSVEAPSVSPARHQ

SEQ ID NO: 5078 - protein, 13 aa, Mus sp.
VHLRVFQPLPHEN

SEQ ID NO: 5079 - protein, 22 aa, Mus sp.
DEDLETKKFRFEEPVVLPDLSD

SEQ ID NO: 5080 - protein, 16 aa, Mus sp.
VLDNYLTSPLPEEVDE

SEQ ID NO: 5081 - protein, 12 aa, Mus sp.
ISWEPPAVSVRY

SEQ ID NO: 5082 - protein, 16 aa, Mus sp.
LIGRTWNDPSVQQDIK

SEQ ID NO: 5083 - protein, 13 aa, Mus sp.
RRYNPPIIHQGFQ

SEQ ID NO: 5084 - protein, 14 aa, Mus sp.
LPNVQVEGPTPNRP

SEQ ID NO: 5085 - protein, 15 aa, Mus sp.
IDIFSTPSSSNSTSK

SEQ ID NO: 5086 - protein, 12 aa, Mus sp.
DHVDFSQPEPHT

SEQ ID NO: 5087 - protein, 14 aa, Mus sp.
AYSSNQTHNLNPLL

SEQ ID NO: 5088 - protein, 17 aa, Mus sp.
KPEDYQGGRTGEAIVDA

SEQ ID NO: 5089 - protein, 18 aa, Mus sp.
GGGDPEAPAPAPAAERPP

SEQ ID NO: 5090 - protein, 19 aa, Mus sp.
MDEATRYLAPTILTDVDPN

SEQ ID NO: 5091 - protein, 16 aa, Mus sp.
GDNLVHAAIVAESAAI

SEQ ID NO: 5092 - protein, 18 aa, Mus sp.
ATPAPSAPAAASATSPSP

SEQ ID NO: 5093 - protein, 24 aa, Mus sp.
APAPAAPAAAEPQAEAPAAAASSE

SEQ ID NO: 5094 - protein, 21 aa, Mus sp.
GPDGKGMNPPSYYTQPVPVPN

SEQ ID NO: 5095 - protein, 16 aa, Mus sp.
EDNVYHSSNAVYRAPS

SEQ ID NO: 5096 - protein, 17 aa, Mus sp.
ADPSAFAAAAPAAAATT

SEQ ID NO: 5097 - protein, 15 aa, Mus sp.
GTVIHFNNPKVQASL

SEQ ID NO: 5098 - protein, 9 aa, Mus sp.
KIFEFKETL

SEQ ID NO: 5099 - protein, 15 aa, Mus sp.
NRYWGTPIPLWVSED

SEQ ID NO: 5100 - protein, 18 aa, Mus sp.
LITGVDFIGSTVGLAKVS

SEQ ID NO: 5101 - protein, 18 aa, Mus sp.
GDLSQHATPLPTPAVLPG

SEQ ID NO: 5102 - protein, 9 aa, Mus sp.
VILLPKDIE

SEQ ID NO: 5103 - protein, 10 aa, Mus sp.
LWPWPQYIQT

SEQ ID NO: 5104 - protein, 16 aa, Mus sp.
SAPPHFHFGQTNRTPE

SEQ ID NO: 5105 - protein, 14 aa, Mus sp.
AVDVFFPPEAQNDF

SEQ ID NO: 5106 - protein, 19 aa, Mus sp.
HPPQEATNSPKPQPSYEEL

SEQ ID NO: 5107 - protein, 14 aa, Mus sp.
DKFWGPSGAESVIG

SEQ ID NO: 5108 - protein, 15 aa, Mus sp.
GVNEYGLPMAVAQVL

SEQ ID NO: 5109 - protein, 15 aa, Mus sp.
SNLLLQSPGVLTAAR

SEQ ID NO: 5110 - protein, 21 aa, Mus sp.
QPTGPPPYHESLAGASQPPYN

SEQ ID NO: 5111 - protein, 14 aa, Mus sp.
KLISFSPTVNTSVS

SEQ ID NO: 5112 - protein, 13 aa, Mus sp.
VDFDFAGPAIHGS

SEQ ID NO: 5113 - protein, 17 aa, Mus sp.
ARDNMFSGSKINYTENR

SEQ ID NO: 5114 - protein, 17 aa, Mus sp.
KELEEQLGPVAEETRAR

SEQ ID NO: 5115 - protein, 16 aa, Mus sp.
VELPPSVSQAAKSPPG

SEQ ID NO: 5116 - protein, 14 aa, Mus sp.
MAFRVPTPNVSVVD

SEQ ID NO: 5117 - protein, 15 aa, Mus sp.
DGNFVEATALHTAPH

SEQ ID NO: 5118 - protein, 15 aa, Mus sp.
TSSYYRGAHGIIVVY

SEQ ID NO: 5119 - protein, 17 aa, Mus sp.
GDGRNYLLAFQKGIRNK

SEQ ID NO: 5120 - protein, 19 aa, Mus sp.
SPLPILSPTVSPSPSPIPP

SEQ ID NO: 5121 - protein, 16 aa, Mus sp.
TSWTYNPAAVSKVAPA

SEQ ID NO: 5122 - protein, 18 aa, Mus sp.
APAPAAAPAAAPAAAPEP

SEQ ID NO: 5123 - protein, 17 aa, Mus sp.
GTSWTYNPAAVSKVAPA

SEQ ID NO: 5124 - protein, 18 aa, Mus sp.
FNNQAYHSPATALAIVDN

SEQ ID NO: 5125 - protein, 16 aa, Mus sp.
DGIEDFVSGVPRAART

SEQ ID NO: 5126 - protein, 15 aa, Mus sp.
GMAFRVPTPNVSVVD

SEQ ID NO: 5127 - protein, 12 aa, Mus sp.
DEGERYIAPTVL

SEQ ID NO: 5128 - protein, 20 aa, Mus sp.
NQGTVIHFNNPKVQASLAAN

SEQ ID NO: 5129 - protein, 13 aa, Mus sp.
APMYYRGAQAAIV

SEQ ID NO: 5130 - protein, 16 aa, Mus sp.
YPENWRAFKALIAAQY

SEQ ID NO: 5131 - protein, 15 aa, Mus sp.
GYPVLYPTGWSSSDN

SEQ ID NO: 5132 - protein, 14 aa, Mus sp.
YYRYMNPAIVAPDA

SEQ ID NO: 5133 - protein, 15 aa, Mus sp.
APMYYRGAQAAIVVY

SEQ ID NO: 5134 - protein, 17 aa, Mus sp.
ATIQWWNMPSPNVDPYD

SEQ ID NO: 5135 - protein, 15 aa, Mus sp.
FPIKWTAPEAALYGR

SEQ ID NO: 5136 - protein, 16 aa, Mus sp.
EEAGAYDGPRTADGIV

SEQ ID NO: 5137 - protein, 13 aa, Mus sp.
WWRSPEPGPSAPG

SEQ ID NO: 5138 - protein, 16 aa, Mus sp.
TSSLAAPTVEAAASAP

SEQ ID NO: 5139 - protein, 18 aa, Mus sp.
MKNVTELNEPLSNEERNL

SEQ ID NO: 5140 - protein, 15 aa, Mus sp.
INIYSASSVSEVNDG

SEQ ID NO: 5141 - protein, 11 aa, Mus sp.
LPYKSPGINVD

SEQ ID NO: 5142 - protein, 15 aa, Mus sp.
EDAIQFATGMANALE

SEQ ID NO: 5143 - protein, 18 aa, Mus sp.
SQMAQYFEPLTLAAVGAA

SEQ ID NO: 5144 - protein, 15 aa, Mus sp.
YALVYTSPVIPELKL

SEQ ID NO: 5145 - protein, 14 aa, Mus sp.
EPYEVHNPVPLIVG

SEQ ID NO: 5146 - protein, 21 aa, Mus sp.
ITFPLKQQRHTAAPTDPTDGP

SEQ ID NO: 5147 - protein, 15 aa, Mus sp.
GKKFTAPHILIATGG

SEQ ID NO: 5148 - protein, 17 aa, Mus sp.
DHDVKIWAPTAEASTEL

SEQ ID NO: 5149 - protein, 15 aa, Mus sp.
KFVYAGSNSGVVQAP

SEQ ID NO: 5150 - protein, 14 aa, Mus sp.
TSIEYVTQRNCNLT

SEQ ID NO: 5151 - protein, 19 aa, Mus sp.
INTVTYEWAPPVQNQALAR

SEQ ID NO: 5152 - protein, 13 aa, Mus sp.
GERFEAPEALFQP

SEQ ID NO: 5153 - protein, 17 aa, Mus sp.
APAAAATTAAPAAAAAP

SEQ ID NO: 5154 - protein, 15 aa, Mus sp.
DTIEFRGPNGLLVYQ

SEQ ID NO: 5155 - protein, 13 aa, Mus sp.
GDSYRSPWSNKYD

SEQ ID NO: 5156 - protein, 16 aa, Mus sp.
LDEYLNSPLPDEIDEN

SEQ ID NO: 5157 - protein, 11 aa, Mus sp.
FVAPAVTPVKG

SEQ ID NO: 5158 - protein, 16 aa, Mus sp.
SGPKPFSAPKPQTSPS

SEQ ID NO: 5159 - protein, 13 aa, Mus sp.
IVKYELPLVIKAL

SEQ ID NO: 5160 - protein, 15 aa, Mus sp.
TKRYMAPEVLDDSIN

SEQ ID NO: 5161 - protein, 17 aa, Mus sp.
VPPTPQPVAPTPSAAPA

SEQ ID NO: 5162 - protein, 16 aa, Mus sp.
LTLPDFHVPEITIPEF

SEQ ID NO: 5163 - protein, 16 aa, Mus sp.
AVLEQEPIVLPAWDPM

SEQ ID NO: 5164 - protein, 19 aa, Mus sp.
MEKEDRRYNPPIIHQGFQD

SEQ ID NO: 5165 - protein, 15 aa, Mus sp.
VGVNEYGLPMAVAQV

SEQ ID NO: 5166 - protein, 19 aa, Mus sp.
SFSGALGVPSFVVPSSGPG

SEQ ID NO: 5167 - protein, 14 aa, Mus sp.
LVHIFKPDVSPNFG

SEQ ID NO: 5168 - protein, 18 aa, Mus sp.
GPDGRFVMGPTVAPSQEK

SEQ ID NO: 5169 - protein, 17 aa, Mus sp.
DLVDAVTPSPQPSKEED

SEQ ID NO: 5170 - protein, 15 aa, Mus sp.
KSIYRYDLASGATEQ

SEQ ID NO: 5171 - protein, 16 aa, Mus sp.
RMAPYQGPDAAPGALD

SEQ ID NO: 5172 - protein, 15 aa, Mus sp.
EEDWTISPVPQSIVD

SEQ ID NO: 5173 - protein, 17 aa, Mus sp.
IEDRDHYIPNTLNPVFG

SEQ ID NO: 5174 - protein, 14 aa, Mus sp.
DAIQFATGMANALE

SEQ ID NO: 5175 - protein, 15 aa, Mus sp.
TAQYKCPVAMEEADD

SEQ ID NO: 5176 - protein, 18 aa, Mus sp.
DEGERYIAPTVLVDVQET

SEQ ID NO: 5177 - protein, 20 aa, Mus sp.
GAEIEYAMAYSKAAFERESD

SEQ ID NO: 5178 - protein, 15 aa, Mus sp.
LNLAYIGAVPHSGIE

SEQ ID NO: 5179 - protein, 14 aa, Mus sp.
SLFLKTPKIVSSKD

SEQ ID NO: 5180 - protein, 13 aa, Mus sp.
DYFKGAIPIRKLV

SEQ ID NO: 5181 - protein, 20 aa, Mus sp.
DEGKLLEAKGPVTDVAYSHD

SEQ ID NO: 5182 - protein, 12 aa, Mus sp.
YYRGAQAAIVVY

SEQ ID NO: 5183 - protein, 16 aa, Mus sp.
EGDIFIGPKAEEHRGL

SEQ ID NO: 5184 - protein, 16 aa, Mus sp.
LTVLEGDPYFTGKLQD

SEQ ID NO: 5185 - protein, 13 aa, Mus sp.
LVFDVTAPNTFKT

SEQ ID NO: 5186 - protein, 15 aa, Mus sp.
DSVVFAGPAGNSVET

SEQ ID NO: 5187 - protein, 16 aa, Mus sp.
DHPGNYVEPTIVTGLA

SEQ ID NO: 5188 - protein, 14 aa, Mus sp.
SMIVNVSCTSACTD

SEQ ID NO: 5189 - protein, 14 aa, Mus sp.
RDNMFSGSKINYTE

SEQ ID NO: 5190 - protein, 14 aa, Mus sp.
AGGHKLGLGLEFQA

SEQ ID NO: 5191 - protein, 17 aa, Mus sp.
SPPGGDFSDPVTSATLG

SEQ ID NO: 5192 - protein, 15 aa, Mus sp.
SPYAFNGGTVLAIAG

SEQ ID NO: 5193 - protein, 15 aa, Mus sp.
VTDYYTLPIGIRTVA

SEQ ID NO: 5194 - protein, 11 aa, Mus sp.
EGYALPHAILR

SEQ ID NO: 5195 - protein, 13 aa, Mus sp.
DNIFLSPLSISTA

SEQ ID NO: 5196 - protein, 14 aa, Mus sp.
DRKIVYEGPELNHA

SEQ ID NO: 5197 - protein, 19 aa, Mus sp.
NPGNPHNVYMPTSQPPPPP

SEQ ID NO: 5198 - protein, 17 aa, Mus sp.
MPEMNIKAPKISMPDID

SEQ ID NO: 5199 - protein, 23 aa, Mus sp.
TPARAPETRSQVTPSVPSEALDD

SEQ ID NO: 5200 - protein, 15 aa, Mus sp.
WKALYTDPKSSETAA

SEQ ID NO: 5201 - protein, 14 aa, Mus sp.
GTPDYIAPEILQGL

SEQ ID NO: 5202 - protein, 21 aa, Mus sp.
TPSPTPENEDLHAATVNPDPS

SEQ ID NO: 5203 - protein, 14 aa, Mus sp.
AFRVPTPNVSVVDL

SEQ ID NO: 5204 - protein, 15 aa, Mus sp.
EVSSVEAPSVSPARH

SEQ ID NO: 5205 - protein, 15 aa, Mus sp.
GYTYTASAIKHVITE

SEQ ID NO: 5206 - protein, 17 aa, Mus sp.
LTGMAFRVPTPNVSVVD

SEQ ID NO: 5207 - protein, 11 aa, Mus sp.
SYPVYLMEQQN

SEQ ID NO: 5208 - protein, 20 aa, Mus sp.
EKPVPAAPVPSPVAPAPVPS

SEQ ID NO: 5209 - protein, 15 aa, Mus sp.
NLDYWTYPGSLTTPP

SEQ ID NO: 5210 - protein, 15 aa, Mus sp.
HDLDFRAPHVLVLGS

SEQ ID NO: 5211 - protein, 16 aa, Mus sp.
NSTDGGSFCHVKASPI

SEQ ID NO: 5212 - protein, 18 aa, Mus sp.
GDLSWHPALTTKSKMRDP

SEQ ID NO: 5213 - protein, 18 aa, Mus sp.
SPVSETVVTPEAAPEKNP

SEQ ID NO: 5214 - protein, 9 aa, Mus sp.
AVYTFETLL

SEQ ID NO: 5215 - protein, 17 aa, Mus sp.
SARTVITPDPNLSIDQV

SEQ ID NO: 5216 - protein, 14 aa, Mus sp.
NLDYVATSIHEAVT

SEQ ID NO: 5217 - protein, 18 aa, Mus sp.
VHKSFVEVNEEGTEAAAA

SEQ ID NO: 5218 - protein, 19 aa, Mus sp.
SAPVEGASPTSISAVDGLT

SEQ ID NO: 5219 - protein, 16 aa, Mus sp.
APAAAEAPAAAEAPAA

SEQ ID NO: 5220 - protein, 15 aa, Listeria monocytogenes
ERWNEKYAQAYPNVS

SEQ ID NO: 5221 - protein, 15 aa, Mus sp.
VGINYQPPTVVPGGD

SEQ ID NO: 5222 - protein, 21 aa, Listeria monocytogenes
APGQETQHYYGLPVADSAIDR

SEQ ID NO: 5223 - protein, 15 aa, Mus sp.
GINYQPPTVVPGGDL

SEQ ID NO: 5224 - protein, 15 aa, Mus sp.
YDLKWEFPRENLEFG

SEQ ID NO: 5225 - protein, 21 aa, Mus sp.
KNVSINTVTYEWAPPVQNQAL

SEQ ID NO: 5226 - protein, 15 aa, Mus sp.
VQPYSGSPANLAAYT

SEQ ID NO: 5227 - protein, 22 aa, Mus sp.
DYNRDGDSYRSPWSNKYDPPLE

SEQ ID NO: 5228 - protein, 16 aa, Mus sp.
ISVAVATPRGLVVPVI

SEQ ID NO: 5229 - protein, 13 aa, Mus sp.
SFKDPKISTSLPV

SEQ ID NO: 5230 - protein, 17 aa, Mus sp.
ERFGVRFPAMSDAYDRD

SEQ ID NO: 5231 - protein, 14 aa, Mus sp.
RDKWLAPDGLIFPD

SEQ ID NO: 5232 - protein, 16 aa, Mus sp.
EGPYYVKPVATTAVEG

SEQ ID NO: 5233 - protein, 18 aa, Mus sp.
VADKEFHAPLIIDENGVH

SEQ ID NO: 5234 - protein, 16 aa, Mus sp.
GIDPYDQPNAIYIERH

SEQ ID NO: 5235 - protein, 15 aa, Mus sp.
LSLLYNVPAVAEEIQ

SEQ ID NO: 5236 - protein, 16 aa, Mus sp.
AKQIVWNGPVGVFEWE

SEQ ID NO: 5237 - protein, 15 aa, Mus sp.
EGEMTLKSALALAVK

SEQ ID NO: 5238 - protein, 14 aa, Mus sp.
ASPELTSPLANQSL

SEQ ID NO: 5239 - protein, 16 aa, Mus sp.
IEEVYYDHLRCAFKSP

SEQ ID NO: 5240 - protein, 15 aa, Mus sp.
VPTVPLLPPQVNQSL

SEQ ID NO: 5241 - protein, 19 aa, Mus sp.
ITDKFWGPSGAESVIGGVH

SEQ ID NO: 5242 - protein, 17 aa, Mus sp.
KILDMFVNPTSSLAYFN

SEQ ID NO: 5243 - protein, 16 aa, Mus sp.
GYKPFQNPVPNQSPSS

SEQ ID NO: 5244 - protein, 16 aa, Mus sp.
SPDVVYSPETIEARYE

SEQ ID NO: 5245 - protein, 9 aa, Mus sp.
FLLFPDMDA

SEQ ID NO: 5246 - protein, 17 aa, Mus sp.
GDTHFDSAEPWTVQNED

SEQ ID NO: 5247 - protein, 13 aa, Mus sp.
NPSYNYEIVNRAS

SEQ ID NO: 5248 - protein, 20 aa, Mus sp.
TPPSPKVTYKAPVPTGEVYF

SEQ ID NO: 5249 - protein, 15 aa, Mus sp.
NLDWQYPGSRGSPPK

SEQ ID NO: 5250 - protein, 15 aa, BOVIN
GAEAEAPSAVPDAAG

SEQ ID NO: 5251 - protein, 17 aa, Mus sp.
LTTSSYSNPTIGYENRV

SEQ ID NO: 5252 - protein, 17 aa, Mus sp.
GDSNFGAPSASVAAAPA

SEQ ID NO: 5253 - protein, 14 aa, Mus sp.
AVKSKYKASIAALE

SEQ ID NO: 5254 - protein, 16 aa, Mus sp.
KPSGYNPPISILGILE

SEQ ID NO: 5255 - protein, 21 aa, Mus sp.
VLITDKFWGPSGAESVIGGVH

SEQ ID NO: 5256 - protein, 16 aa, Mus sp.
GTKRYMAPEVLDETIN

SEQ ID NO: 5257 - protein, 17 aa, Mus sp.
YPFDFQGAKIITGQEEG

SEQ ID NO: 5258 - protein, 14 aa, Mus sp.
DKDSFSDPYAHVSF

SEQ ID NO: 5259 - protein, 13 aa, Mus sp.
RYNPPIIHQGFQD

SEQ ID NO: 5260 - protein, 15 aa, Mus sp.
LTPWLAPIVSEGTFD

SEQ ID NO: 5261 - protein, 13 aa, Mus sp.
ADKEFHAPLIIDE

SEQ ID NO: 5262 - protein, 12 aa, Mus sp.
LFHNPHVNPLPT

SEQ ID NO: 5263 - protein, 11 aa, Mus sp.
LKPEYVAPLVL

SEQ ID NO: 5264 - protein, 15 aa, Mus sp.
DDPIWRGPLPSNGVM

SEQ ID NO: 5265 - protein, 14 aa, Mus sp.
WTFSTTGALESAVA

SEQ ID NO: 5266 - protein, 18 aa, Mus sp.
IGRTWNDPSVQQDIKFLP

SEQ ID NO: 5267 - protein, 14 aa, Mus sp.
GTPEFLAPEVLTDT

SEQ ID NO: 5268 - protein, 19 aa, Mus sp.
GGPGSAVSPYPSFNVSSDV

SEQ ID NO: 5269 - protein, 17 aa, Mus sp.
FADDTYTESYISTIGVD

SEQ ID NO: 5270 - protein, 14 aa, Mus sp.
VEALEQPAPAIVSA

SEQ ID NO: 5271 - protein, 11 aa, Mus sp.
VATSIHEAVTK

SEQ ID NO: 5272 - protein, 15 aa, Mus sp.
STDYGNFLANEASPL

SEQ ID NO: 5273 - protein, 17 aa, Mus sp.
TGMAFRVPTPNVSVVDL

SEQ ID NO: 5274 - protein, 19 aa, Mus sp.
VPEESSSFEGAQVEHSTSR

SEQ ID NO: 5275 - protein, 18 aa, Mus sp.
EETAFQTPKPSQTPSVPP

SEQ ID NO: 5276 - protein, 15 aa, Mus sp.
EDYVELPPSVSQAAT

SEQ ID NO: 5277 - protein, 14 aa, Mus sp.
IFYGASIASLSASH

SEQ ID NO: 5278 - protein, 14 aa, Mus sp.
IDIFARPTAGFITG

SEQ ID NO: 5279 - protein, 19 aa, Mus sp.
KPKGQLPDYTSPVVLPYSR

SEQ ID NO: 5280 - protein, 17 aa, Mus sp.
DDLPTTFQGATASTSYG

SEQ ID NO: 5281 - protein, 14 aa, Mus sp.
GYTYTASAIKHVIT

SEQ ID NO: 5282 - protein, 15 aa, Mus sp.
VTYEWAPPVQNQALA

SEQ ID NO: 5283 - protein, 12 aa, Mus sp.
NWSLPNRAVEPQ

SEQ ID NO: 5284 - protein, 9 aa, Mus sp.
ELFPVFTQL

SEQ ID NO: 5285 - protein, 18 aa, Mus sp.
NSNSYGIPEPAHAYAQPQ

SEQ ID NO: 5286 - protein, 17 aa, Mus sp.
HKLSYLTFIPSDDDIYD

SEQ ID NO: 5287 - protein, 16 aa, Mus sp.
EFDYSGSQAIKALKEE

SEQ ID NO: 5288 - protein, 18 aa, Mus sp.
VPAQSTFWRPQTQEERPH

SEQ ID NO: 5289 - protein, 14 aa, Mus sp.
SLEDFYGSPIPSVS

SEQ ID NO: 5290 - protein, 29 aa, Mus sp.
KKVNRITGLDPAGPNFEYAEAPSRLSPDD

SEQ ID NO: 5291 - protein, 16 aa, Mus sp.
SESSVSTPSASFEPDV

SEQ ID NO: 5292 - protein, 14 aa, Mus sp.
VTQFHPPHIEIQML

SEQ ID NO: 5293 - protein, 16 aa, Mus sp.
TTVEYLAPWANQIDMA

SEQ ID NO: 5294 - protein, 14 aa, Mus sp.
QKTQYISPNLNPND

SEQ ID NO: 5295 - protein, 17 aa, Mus sp.
DPKLTYHGFTLEDAASP

SEQ ID NO: 5296 - protein, 16 aa, Mus sp.
LPKPIIWAEPGSVIAA

SEQ ID NO: 5297 - protein, 19 aa, Listeria monocytogenes
SNVNHVLDIGYGGGSNVKN

SEQ ID NO: 5298 - protein, 18 aa, Mus sp.
RQPAWRDPLSPFAVGGDD

SEQ ID NO: 5299 - protein, 21 aa, Mus sp.
EDPNYSPQRFPNAHRAFADDP

SEQ ID NO: 5300 - protein, 16 aa, Mus sp.
VPFWAHAGNAIPSADQ

SEQ ID NO: 5301 - protein, 15 aa, Mus sp.
LDNYLTSPLPEEVDE

SEQ ID NO: 5302 - protein, 16 aa, Mus sp.
RATTYIDPRTGKSALD

SEQ ID NO: 5303 - protein, 24 aa, Mus sp.
VPDGPEAPLDELVGAYPNYNEEEE

SEQ ID NO: 5304 - protein, 12 aa, Mus sp.
EPYLEPRSPEAR

SEQ ID NO: 5305 - protein, 17 aa, Mus sp.
GGYKPFQNPVPNQSPSS

SEQ ID NO: 5306 - protein, 14 aa, Mus sp.
FDYSGSQAIKALKE

SEQ ID NO: 5307 - protein, 13 aa, Mus sp.
DTIEFRGPNGLLV

SEQ ID NO: 5308 - protein, 16 aa, Mus sp.
AGPQWADPQISESNFS

SEQ ID NO: 5309 - protein, 13 aa, Mus sp.
GDSERHFVYQFMG

SEQ ID NO: 5310 - protein, 9 aa, Mus sp.
FAYEGRDYI

SEQ ID NO: 5311 - protein, 19 aa, Mus sp.
EPPPPRSHYSNIEANESEE

SEQ ID NO: 5312 - protein, 14 aa, Mus sp.
DIYVWRGAQATLSN

SEQ ID NO: 5313 - protein, 14 aa, Mus sp.
VNFQEYVAFLGALA

SEQ ID NO: 5314 - protein, 16 aa, Mus sp.
NLPENFRRPQTDQAVE

SEQ ID NO: 5315 - protein, 21 aa, Mus sp.
EKPVPAAPVPSPVAPAPVPSR

SEQ ID NO: 5316 - protein, 19 aa, Mus sp.
EQPGLNGAAAAAAAEAPDE

SEQ ID NO: 5317 - protein, 17 aa, Mus sp.
GTTVYRQFWIFDVQNPD

SEQ ID NO: 5318 - protein, 16 aa, Mus sp.
FTAQWIAPSVQLTGYR

SEQ ID NO: 5319 - protein, 19 aa, Mus sp.
DPAVIKSLTIQPDPIVVPG

SEQ ID NO: 5320 - protein, 21 aa, BOVIN
SVVVGPSVVAVPLPLHRAHYD

SEQ ID NO: 5321 - protein, 18 aa, Mus sp.
SVPPSVSPSPATAFSGPP

SEQ ID NO: 5322 - protein, 14 aa, Mus sp.
VQIYHNPTANSFRV

SEQ ID NO: 5323 - protein, 20 aa, Listeria monocytogenes
ADFRYVFDTAKATAASSYPG

SEQ ID NO: 5324 - protein, 12 aa, Mus sp.
TIPFYTPIPNGL

SEQ ID NO: 5325 - protein, 15 aa, Mus sp.
KNVTELNEPLSNEER

SEQ ID NO: 5326 - protein, 14 aa, Mus sp.
LFPQYTAPSILPSD

SEQ ID NO: 5327 - protein, 17 aa, Mus sp.
YIEGYVPSQADVAVFEA

SEQ ID NO: 5328 - protein, 18 aa, Mus sp.
FPKTNATSPGVNSSASPQ

SEQ ID NO: 5329 - protein, 17 aa, Mus sp.
GEQKLFISPGLLPEAPT

SEQ ID NO: 5330 - protein, 16 aa, Mus sp.
VDMARVVAPFMSNIPL

SEQ ID NO: 5331 - protein, 16 aa, Mus sp.
RPEEVEAEAVNRSITI

SEQ ID NO: 5332 - protein, 17 aa, Mus sp.
SPGILQASPTPLLAAAA

SEQ ID NO: 5333 - protein, 20 aa, Mus sp.
TPSAAYLWVGAGASEAEKTG

SEQ ID NO: 5334 - protein, 24 aa, Mus sp.
LPDGRIIKVGGERFEAPEALFQPH

SEQ ID NO: 5335 - protein, 11 aa, Mus sp.
FHNPHVNPLPT

SEQ ID NO: 5336 - protein, 16 aa, Mus sp.
MDLDIFNLPNVEISKD

SEQ ID NO: 5337 - protein, 15 aa, Mus sp.
FDQGYEAPGVREAAA

SEQ ID NO: 5338 - protein, 14 aa, Mus sp.
VPWSPPQSNWNPWT

SEQ ID NO: 5339 - protein, 17 aa, Mus sp.
VFDVTAPNTFKTLDSWR

SEQ ID NO: 5340 - protein, 19 aa, Mus sp.
EPPQVPAEAPQPRASEDSP

SEQ ID NO: 5341 - protein, 17 aa, Mus sp.
LNLAYIGAVPHSGIEQV

SEQ ID NO: 5342 - protein, 20 aa, Mus sp.
GVPVPGSPFPLEAVAPTKPS

SEQ ID NO: 5343 - protein, 17 aa, Mus sp.
IGFRYVHPLTEEAIEEM

SEQ ID NO: 5344 - protein, 15 aa, Mus sp.
LQQEFQRAQAAKAPG

SEQ ID NO: 5345 - protein, 16 aa, BOVIN
SVVVGPSVVAVPLPLH

SEQ ID NO: 5346 - protein, 16 aa, Mus sp.
APLPPWKTPSSSQPPP

SEQ ID NO: 5347 - protein, 20 aa, Mus sp.
APISSHTAPRPNPTPALPQP

SEQ ID NO: 5348 - protein, 15 aa, Mus sp.
HPIQWNAPEPSHITK

SEQ ID NO: 5349 - protein, 15 aa, Mus sp.
KSKYKASIAALEAKI

SEQ ID NO: 5350 - protein, 13 aa, Mus sp.
EVSSVEAPSVSPA

SEQ ID NO: 5351 - protein, 17 aa, Mus sp.
KPNGIFKGPTAENAEYL

SEQ ID NO: 5352 - protein, 27 aa, Mus sp.
DEPQGWDLVDAVTPSPQPSKEEDGPPA

SEQ ID NO: 5353 - protein, 23 aa, Mus sp.
LPNKPTVTVVSPLPNDSINPQPS

SEQ ID NO: 5354 - protein, 13 aa, Mus sp.
SLKYHFVTPLTSM

SEQ ID NO: 5355 - protein, 14 aa, Mus sp.
DASFVAAIPSTQVV

SEQ ID NO: 5356 - protein, 15 aa, Mus sp.
APPHFHFGQTNRTPE

SEQ ID NO: 5357 - protein, 14 aa, Mus sp.
LDWQYPGSRGSPPK

SEQ ID NO: 5358 - protein, 18 aa, Mus sp.
IDFEDVIAEPEGTHSFDG

SEQ ID NO: 5359 - protein, 8 aa, Mus sp.
AVYSFEAL

SEQ ID NO: 5360 - protein, 14 aa, Mus sp.
KNLDYVATSIHEAV

SEQ ID NO: 5361 - protein, 17 aa, Mus sp.
DPEDHTVSFVQPNGAIF

SEQ ID NO: 5362 - protein, 21 aa, Mus sp.
GSKVDFVAWATGEPNFANDDE

SEQ ID NO: 5363 - protein, 16 aa, Mus sp.
KPTVTVVSPLPNDSIN

SEQ ID NO: 5364 - protein, 18 aa, Mus sp.
GNRITPSYVAFTPEGERL

SEQ ID NO: 5365 - protein, 16 aa, Mus sp.
MQLTYLPPSPVLAEST

SEQ ID NO: 5366 - protein, 14 aa, Mus sp.
IRYMAPEVLEGAVN

SEQ ID NO: 5367 - protein, 16 aa, Mus sp.
SSIASFKDPKISTSLP

SEQ ID NO: 5368 - protein, 15 aa, Mus sp.
IGVGAYVSPDMMVAE

SEQ ID NO: 5369 - protein, 17 aa, Mus sp.
FVLPANAFASPLQNPDN

SEQ ID NO: 5370 - protein, 15 aa, Mus sp.
GPPIFNPVANEVYLN

SEQ ID NO: 5371 - protein, 16 aa, Mus sp.
RERYNFPNPNPFVEDD

SEQ ID NO: 5372 - protein, 22 aa, Mus sp.
EQLPNVQVEGPTPNRPRKQLPS

SEQ ID NO: 5373 - protein, 16 aa, Mus sp.
EPTGVYHQTTLHMALS

SEQ ID NO: 5374 - protein, 19 aa, Mus sp.
TETKVEPYEVHNPVPLIVG

SEQ ID NO: 5375 - protein, 17 aa, Mus sp.
DSNFGAPSASVAAAPAP

SEQ ID NO: 5376 - protein, 12 aa, Mus sp.
FPYVTPAPHEPV

SEQ ID NO: 5377 - protein, 15 aa, Mus sp.
FPQYTAPSILPSDIT

SEQ ID NO: 5378 - protein, 28 aa, Mus sp.
MQNLGMTSPLPFDSLGYNASHHPFAGYP

SEQ ID NO: 5379 - protein, 17 aa, Mus sp.
GTVIHFNNPKVQASLAA

SEQ ID NO: 5380 - protein, 19 aa, Mus sp.
VDSPDVVYSPETIEARYEY

SEQ ID NO: 5381 - protein, 16 aa, Mus sp.
SLVSWVGSEPMPEAGL

SEQ ID NO: 5382 - protein, 15 aa, Mus sp.
GGERFEAPEALFQPH

SEQ ID NO: 5383 - protein, 14 aa, Mus sp.
VDLPNYSSPNALVL

SEQ ID NO: 5384 - protein, 15 aa, Mus sp.
TDKFWGPSGAESVIG

SEQ ID NO: 5385 - protein, 18 aa, Mus sp.
DPAKGRIYQGTEADSIFS

SEQ ID NO: 5386 - protein, 16 aa, Mus sp.
SIVYWMTSQPSDAVRF

SEQ ID NO: 5387 - protein, 14 aa, Mus sp.
KVELVPPTPAEIPT

SEQ ID NO: 5388 - protein, 14 aa, Mus sp.
VQTYVGAISNGSLP

SEQ ID NO: 5389 - protein, 15 aa, Mus sp.
SQGNLIPARPAPAPP

SEQ ID NO: 5390 - protein, 16 aa, Listeria monocytogenes
DGLTWHDGKPLTADDV

SEQ ID NO: 5391 - protein, 14 aa, Mus sp.
APVPSPVAPAPVPS

SEQ ID NO: 5392 - protein, 14 aa, Mus sp.
DGFSWPATLPSVYK

SEQ ID NO: 5393 - protein, 15 aa, Mus sp.
TPDYISPEILQAMED

SEQ ID NO: 5394 - protein, 15 aa, Mus sp.
NPEAMVAPSVLSNIQ

SEQ ID NO: 5395 - protein, 20 aa, Mus sp.
IGDTIEFRGPNGLLVYQGKG

SEQ ID NO: 5396 - protein, 30 aa, Mus sp.; identical to SEQ ID NO: 2540

SEQ ID NO: 5397 - protein, 19 aa, Mus sp.
TNNQDFRGSAGAPSVENVK

SEQ ID NO: 5398 - protein, 20 aa, Mus sp.
SEPTTLFKTASALRSSAPLN

SEQ ID NO: 5399 - protein, 16 aa, Listeria monocytogenes
GGINQAYTGSTALSDG

SEQ ID NO: 5400 - protein, 14 aa, Mus sp.
GAWTGPMGNWAMFT

SEQ ID NO: 5401 - protein, 15 aa, Mus sp.
GRPDAEYWNSQPEIL

SEQ ID NO: 5402 - protein, 18 aa, Mus sp.
FPPEFYEHAKALWEDEGV

SEQ ID NO: 5403 - protein, 16 aa, Mus sp.
EEIEVAPPKAHEVRIK

SEQ ID NO: 5404 - protein, 16 aa, Mus sp.
KLQEFELPYVSVTSLR

SEQ ID NO: 5405 - protein, 13 aa, Mus sp.
LPDYSAPNPIKVT

SEQ ID NO: 5406 - protein, 18 aa, Mus sp.
RSLQAFSNPSAGISVDVK

SEQ ID NO: 5407 - protein, 16 aa, Mus sp.
LQFGYNTGVINAPQKV

SEQ ID NO: 5408 - protein, 12 aa, Mus sp.
VGGERFEAPEAL

SEQ ID NO: 5409 - protein, 11 aa, Mus sp.
ANVGWNGSTFA

SEQ ID NO: 5410 - protein, 20 aa, Mus sp.
DVVDRVLKSPVASIVYELNP

SEQ ID NO: 5411 - protein, 15 aa, Mus sp.
VDPYEEADAQIAQER

SEQ ID NO: 5412 - protein, 13 aa, Mus sp.
TPYYVAPEVLGPE

SEQ ID NO: 5413 - protein, 15 aa, Mus sp.
KFLPNAPKALIVEPS

SEQ ID NO: 5414 - protein, 14 aa, Mus sp.
LQVYAPEVSPESIM

SEQ ID NO: 5415 - protein, 21 aa, Mus sp.
IDLKGIPVYRFVLPANAFASP

SEQ ID NO: 5416 - protein, 18 aa, Mus sp.
AANEKAVHADFFNDFEDL

SEQ ID NO: 5417 - protein, 13 aa, Mus sp.
TVEYLAPWANQID

SEQ ID NO: 5418 - protein, 19 aa, Mus sp.
NPQMPQYTSPQPGSALSPR

SEQ ID NO: 5419 - protein, 17 aa, Mus sp.
APPLPIKTPIPTPSTLP

SEQ ID NO: 5420 - protein, 16 aa, Mus sp.
IPETYPFNPPKVRFIT

SEQ ID NO: 5421 - protein, 14 aa, Mus sp.
KQIDYTVPTVIAEE

SEQ ID NO: 5422 - protein, 21 aa, Mus sp.
GVEAARDNMFSGSKINYTENR

SEQ ID NO: 5423 - protein, 18 aa, Mus sp.
SADDFFQGTKAALAGGTT

SEQ ID NO: 5424 - protein, 15 aa, Mus sp.
KTPEIVAPESAHAAF

SEQ ID NO: 5425 - protein, 24 aa, Mus sp.
GQDGEQAPPLPIKTPIPTPSTLPA

SEQ ID NO: 5426 - protein, 16 aa, Mus sp.
INKMDDPTVNWSNERY

SEQ ID NO: 5427 - protein, 15 aa, Mus sp.
APAPEFTAAQPEVAD

SEQ ID NO: 5428 - protein, 17 aa, Mus sp.
GQDHVDFSQPEPHTVLF

SEQ ID NO: 5429 - protein, 21 aa, Mus sp.
REPPPAYEPPAPAPAPLPPPS

SEQ ID NO: 5430 - protein, 17 aa, Mus sp.
EPYAHAAPESIPATFED

SEQ ID NO: 5431 - protein, 17 aa, Mus sp.
AREGSYEAAKILLDHFA

SEQ ID NO: 5432 - protein, 10 aa, Mus sp.
DPKISTSLPV

SEQ ID NO: 5433 - protein, 25 aa, Mus sp.
ANLMEKIQASVATNPIITPVAQENQ

SEQ ID NO: 5434 - protein, 21 aa, Mus sp.
SDEGERYIAPTVLVDVQETEP

SEQ ID NO: 5435 - protein, 18 aa, Mus sp.
ADGREVSSVEAPSVSPAR

SEQ ID NO: 5436 - protein, 13 aa, Mus sp.
EDNWSLPNRAVEP

SEQ ID NO: 5437 - protein, 15 aa, Mus sp.
KQIVWNGPVGVFEWE

SEQ ID NO: 5438 - protein, 18 aa, Mus sp.
VLRYNITHPVVNDADASL

SEQ ID NO: 5439 - protein, 14 aa, Mus sp.
SPTYTPSSPSYSPS

SEQ ID NO: 5440 - protein, 16 aa, Mus sp.
APDMVYLGSMTNFDVT

SEQ ID NO: 5441 - protein, 17 aa, Mus sp.
REQFSYVLPTVHSLEPS

SEQ ID NO: 5442 - protein, 22 aa, Mus sp.
KDEGKLLEAKGPVTDVAYSHDG

SEQ ID NO: 5443 - protein, 15 aa, Mus sp.
AKVELVPPTPAEIPT

SEQ ID NO: 5444 - protein, 8 aa, Mus sp.
ATLVFHNL

SEQ ID NO: 5445 - protein, 16 aa, Mus sp.
LDNYLTSPLPEEVDET

SEQ ID NO: 5446 - protein, 16 aa, Mus sp.
IPKVVKSPSSLPAKPL

SEQ ID NO: 5447 - protein, 16 aa, Mus sp.
LPQDPTFHTPLDLYAY

SEQ ID NO: 5448 - protein, 17 aa, Mus sp.
NPDYKGTWIHPEIDNPE

SEQ ID NO: 5449 - protein, 23 aa, Mus sp.
VPDGPEAPLDELVGAYPNYNEEE

SEQ ID NO: 5450 - protein, 13 aa, Mus sp.
IDIFARPTAGFIT

SEQ ID NO: 5451 - protein, 16 aa, Mus sp.
SNDVHMYLPTKLFQPS

SEQ ID NO: 5452 - protein, 16 aa, Mus sp.
AAPASAPTPSTPAPTP

SEQ ID NO: 5453 - protein, 22 aa, Mus sp.
DPAGPNFEYAEAPSRLSPDDAD

SEQ ID NO: 5454 - protein, 17 aa, Mus sp.
GTPEYLAPEIILSKGYN

SEQ ID NO: 5455 - protein, 17 aa, Mus sp.
SIASFKDPKISTSLPVL

SEQ ID NO: 5456 - protein, 17 aa, Mus sp.
GRERYNFPNPNPFVEDD

SEQ ID NO: 5457 - protein, 27 aa, Mus sp.
SNDTTVLLPPYDDATAVPSTAKEPPPP

SEQ ID NO: 5458 - protein, 25 aa, Mus sp.
LPDGRIIKVGGERFEAPEALFQPHL

SEQ ID NO: 5459 - protein, 18 aa, Mus sp.
GDTIEFRGPNGLLVYQGK

SEQ ID NO: 5460 - protein, 18 aa, Mus sp.
GTVIHFNNPKVQASLAAN

SEQ ID NO: 5461 - protein, 17 aa, Mus sp.
ISALEYGMPVTLIGEAV

SEQ ID NO: 5462 - protein, 16 aa, Mus sp.
RDLKWGTPVPLEGFED

SEQ ID NO: 5463 - protein, 22 aa, Mus sp.
GPNDERFGVRFPAMSDAYDRDM

SEQ ID NO: 5464 - protein, 22 aa, Mus sp.
LPEEVGEYRQPSGGSVPVSPGP

SEQ ID NO: 5465 - protein, 15 aa, Mus sp.
LPENFRRPQTDQAVE

SEQ ID NO: 5466 - protein, 16 aa, Mus sp.
SEWKFTITPPSAQVVG

SEQ ID NO: 5467 - protein, 23 aa, Mus sp.
APTPSTPAPTPAATPAASPAPVS

SEQ ID NO: 5468 - protein, 19 aa, Mus sp.
VDGDVVHGFYNPAVSRIVE

SEQ ID NO: 5469 - protein, 17 aa, Mus sp.
INMKQYASPMPTQTDVK

SEQ ID NO: 5470 - protein, 15 aa, Mus sp.
VADKEFHAPLIIDEN

SEQ ID NO: 5471 - protein, 17 aa, Mus sp.
IPEQSFYTKPLPGIIMG

SEQ ID NO: 5472 - protein, 14 aa, Mus sp.
DHPGNYVEPTIVTG

SEQ ID NO: 5473 - protein, 20 aa, Mus sp.
TEDGDMRLVNGASANEGRVE

SEQ ID NO: 5474 - protein, 15 aa, Mus sp.
GSTLWSSPLPEEAQD

SEQ ID NO: 5475 - protein, 16 aa, Mus sp.
ASVATNPIITPVAQEN

SEQ ID NO: 5476 - protein, 27 aa, Mus sp.
APTPSTPAPTPAATPAASPAPVSSDPA

SEQ ID NO: 5477 - protein, 24 aa, Mus sp.
SPDDADFVDVLHTFTRGSPGRSIG

SEQ ID NO: 5478 - protein, 17 aa, Mus sp.
IESKEAFQEALAAAGDK

SEQ ID NO: 5479 - protein, 16 aa, Mus sp.
IMFETFNTPAMYVAIQ

SEQ ID NO: 5480 - protein, 16 aa, Mus sp.
EEVEHWFYPQENIIDT

SEQ ID NO: 5481 - protein, 15 aa, Mus sp.
YPNSFSAPEQQRSAL

SEQ ID NO: 5482 - protein, 18 aa, Mus sp.
EQPGLNGAAAAAAAEAPD

SEQ ID NO: 5483 - protein, 16 aa, Mus sp.
EMYKVHNPVPLIVGSS

SEQ ID NO: 5484 - protein, 20 aa, Mus sp.
SPGFSSEVYTFPVPERHLER

SEQ ID NO: 5485 - protein, 15 aa, Mus sp.
VKELFTTPVLRASVS

SEQ ID NO: 5486 - protein, 15 aa, Mus sp.
FDYSGSQAIKALKEE

SEQ ID NO: 5487 - protein, 17 aa, Mus sp.
DIDTAAKFIGAGAATVG

SEQ ID NO: 5488 - protein, 17 aa, Mus sp.
SQELVRAPTAALSPEPQ

SEQ ID NO: 5489 - protein, 17 aa, Mus sp.
HWGEWSPAHPLEAEDTR

SEQ ID NO: 5490 - protein, 17 aa, Mus sp.
DLPNSFDGPVTITIVNR

SEQ ID NO: 5491 - protein, 20 aa, Mus sp.
FYVDLDKKETVWMLPEFGQL

SEQ ID NO: 5492 - protein, 18 aa, Mus sp.
GPHSMRYFETAVSRPGLE

SEQ ID NO: 5493 - protein, 13 aa, Mus sp.
TSSYSNPTIGYEN

SEQ ID NO: 5494 - protein, 18 aa, Mus sp.
RPVQFPYVTPAPHEPVKT

SEQ ID NO: 5495 - protein, 16 aa, Mus sp.
ERDSKIVVPPLPGKAL

SEQ ID NO: 5496 - protein, 15 aa, Mus sp.
GPGGLWVWGAPAVAQ

SEQ ID NO: 5497 - protein, 19 aa, Mus sp.
APLNVQFSSPLPGEAVKDL

SEQ ID NO: 5498 - protein, 15 aa, Mus sp.
LVKDGYQMAQPVFAP

SEQ ID NO: 5499 - protein, 15 aa, Mus sp.
EVEHWFYPQENIIDT

SEQ ID NO: 5500 - protein, 14 aa, Mus sp.
AVNWYAPLVAPISK

SEQ ID NO: 5501 - protein, 18 aa, Mus sp.
APLNVQFSSPLPGEAVKD

SEQ ID NO: 5502 - protein, 17 aa, Mus sp.
ESLHLRFSAPQIENEPE

SEQ ID NO: 5503 - protein, 14 aa, Mus sp.
YTPYYVAPEVLGPE

SEQ ID NO: 5504 - protein, 16 aa, Mus sp.
VDHRGTWNGPWVSTEV

SEQ ID NO: 5505 - protein, 19 aa, Mus sp.
NPTDAYLDAMMNEAPGPIN

SEQ ID NO: 5506 - protein, 15 aa, Mus sp.
LPETFRRPQIDPAVE

SEQ ID NO: 5507 - protein, 15 aa, Mus sp.
AGPQWADPQISESNF

SEQ ID NO: 5508 - protein, 16 aa, Mus sp.
RPVQFPYVTPAPHEPV

SEQ ID NO: 5509 - protein, 14 aa, Mus sp.
HVEGYEGSAASIST

SEQ ID NO: 5510 - protein, 14 aa, Mus sp.
GFPYEGPAPLEAIA

SEQ ID NO: 5511 - protein, 16 aa, Mus sp.
GMAFRVPTPNVSVVDL

SEQ ID NO: 5512 - protein, 14 aa, Mus sp.
SKNVFLSPMSISSA

SEQ ID NO: 5513 - protein, 14 aa, Mus sp.
DTIEFRGPNGLLVY

SEQ ID NO: 5514 - protein, 16 aa, Mus sp.
WHIQADHAYQALPSFQ

SEQ ID NO: 5515 - protein, 14 aa, Mus sp.
KDGYQMAQPVFAPK

SEQ ID NO: 5516 - protein, 16 aa, Mus sp.
TNDRYVASLAARNKVG

SEQ ID NO: 5517 - protein, 27 aa, Mus sp.
VPPAGGGDPEAPAPAPAAERPPAPGPG

SEQ ID NO: 5518 - protein, 14 aa, Mus sp.
EEIEVAPPKAHEVR

SEQ ID NO: 5519 - protein, 14 aa, Mus sp.
DPAWEAPEGVPIDA

SEQ ID NO: 5520 - protein, 24 aa, Mus sp.
IQEMEKEDRRYNPPIIHQGFQDTS

SEQ ID NO: 5521 - protein, 16 aa, Mus sp.
VMRIINEPTAAAIAYG

SEQ ID NO: 5522 - protein, 16 aa, Mus sp.
EPYEVHNPVPLIVGSS

SEQ ID NO: 5523 - protein, 17 aa, Mus sp.
KGPAFVNPLIPENKEEE

SEQ ID NO: 5524 - protein, 18 aa, Mus sp.
YVPPPFAAAAINEAIDAE

SEQ ID NO: 5525 - protein, 14 aa, Mus sp.
RPDAEYWNSQPEIL

SEQ ID NO: 5526 - protein, 13 aa, Mus sp.
VYHEPHIADAWPQ

SEQ ID NO: 5527 - protein, 17 aa, Mus sp.
EPSKYYYEVSLPSGLEE

SEQ ID NO: 5528 - protein, 13 aa, Mus sp.
VPSRDYAYSIING

SEQ ID NO: 5529 - protein, 15 aa, Mus sp.
RDKWLAPDGLIFPDR

SEQ ID NO: 5530 - protein, 15 aa, Mus sp.
ADDIVGPVTHEIFEN

SEQ ID NO: 5531 - protein, 12 aa, Mus sp.
VTPWKAPIVWEG

SEQ ID NO: 5532 - protein, 16 aa, Mus sp.
ESKATYSTNSPVWEEA

SEQ ID NO: 5533 - protein, 17 aa, Mus sp.
KWKALYTDPKSSETAAF

SEQ ID NO: 5534 - protein, 15 aa, Mus sp.
TPDYIAPEIIAYQPY

SEQ ID NO: 5535 - protein, 31 aa, Listeria monocytogenes; identical to SEQ ID NO: 420

SEQ ID NO: 5536 - protein, 15 aa, Mus sp.
YPNQVYYRPVDQYSN

SEQ ID NO: 5537 - protein, 20 aa, Mus sp.
MEKEDRRYNPPIIHQGFQDT

SEQ ID NO: 5538 - protein, 17 aa, Mus sp.
KNVTELNEPLSNEERNL

SEQ ID NO: 5539 - protein, 15 aa, Mus sp.
LPPHVYSTPQPSLPP

SEQ ID NO: 5540 - protein, 16 aa, Mus sp.
KFIYVDVLPEEAVGPV

SEQ ID NO: 5541 - protein, 13 aa, Mus sp.
QREEYQPATPGLG

SEQ ID NO: 5542 - protein, 18 aa, Mus sp.
IKPGTTVEYLAPWANQID

SEQ ID NO: 5543 - protein, 16 aa, Mus sp.
DEEEVEVFLPKFKLEE

SEQ ID NO: 5544 - protein, 17 aa, Mus sp.
DIRSDWTNPEINKAVLH

SEQ ID NO: 5545 - protein, 16 aa, Mus sp.
DIDSFVPSKAAPAAAA

SEQ ID NO: 5546 - protein, 19 aa, Mus sp.
EDPDGFSWPATLPSVYKQP

SEQ ID NO: 5547 - protein, 16 aa, Mus sp.
VPNDKWFGSGALLSES

SEQ ID NO: 5548 - protein, 20 aa, Mus sp.
IDNSKEFEFIESQTSSHRIN

SEQ ID NO: 5549 - protein, 14 aa, Mus sp.
AGEFDYSGSQAIKA

SEQ ID NO: 5550 - protein, 17 aa, Mus sp.
GQNAWFLPAQADIVATK

SEQ ID NO: 5551 - protein, 17 aa, Mus sp.
APAPEFTAAQPEVADWS

SEQ ID NO: 5552 - protein, 16 aa, Mus sp.
VLEMYKVHNPVPLIVG

SEQ ID NO: 5553 - protein, 13 aa, Mus sp.
EDRRYNPPIIHQG

SEQ ID NO: 5554 - protein, 19 aa, Mus sp.
TDDEKVRVSYYGPKTSPVQ

SEQ ID NO: 5555 - protein, 20 aa, Mus sp.
VPPTPQPVAPTPSAAPAGPK

SEQ ID NO: 5556 - protein, 14 aa, Mus sp.
LSYAVSWAKVSESG

SEQ ID NO: 5557 - protein, 15 aa, Mus sp.
GVDFIGSTVGLAKVS

SEQ ID NO: 5558 - protein, 15 aa, Mus sp.
STTEFEEPRVIDLWD

SEQ ID NO: 5559 - protein, 14 aa, Mus sp.
IGDSNFGAPSASVA

SEQ ID NO: 5560 - protein, 15 aa, Mus sp.
GDQPVFEIPLSNVSQ

SEQ ID NO: 5561 - protein, 17 aa, Mus sp.
APINAFIGGLAAQEVMK

SEQ ID NO: 5562 - protein, 14 aa, Mus sp.
HDLDFRAPHVLVLG

SEQ ID NO: 5563 - protein, 15 aa, Mus sp.
INDYKGAVIVVSHDA

SEQ ID NO: 5564 - protein, 14 aa, Mus sp.
EMYKVHNPVPLIVG

SEQ ID NO: 5565 - protein, 17 aa, Mus sp.
LPKEELYMPPLVIKVID

SEQ ID NO: 5566 - protein, 16 aa, Mus sp.
HNKLYVLQWLTLFFDN

SEQ ID NO: 5567 - protein, 14 aa, Mus sp.
KKAGYITPVPGGVG

SEQ ID NO: 5568 - protein, 20 aa, Mus sp.
GPPGFEDYVELPPSVSQAAK

SEQ ID NO: 5569 - protein, 17 aa, Mus sp.
EVSSVEAPSVSPARHQL

SEQ ID NO: 5570 - protein, 13 aa, Mus sp.
LPQDPTFHTPLDL

SEQ ID NO: 5571 - protein, 23 aa, Mus sp.
LPEEVGEYRQPSGGSVPVSPGPP

SEQ ID NO: 5572 - protein, 19 aa, Mus sp.
EDGDMRLVNGASANEGRVE

SEQ ID NO: 5573 - protein, 25 aa, Mus sp.
GSEIDLKGIPVYRFVLPANAFASPL

SEQ ID NO: 5574 - protein, 16 aa, Mus sp.
FSPYAAPSPQGSYQPS

SEQ ID NO: 5575 - protein, 13 aa, Mus sp.
ALPYDTPVPGYMN

SEQ ID NO: 5576 - protein, 16 aa, Mus sp.
DVPEWFRGSRLNYAEN

SEQ ID NO: 5577 - protein, 16 aa, Mus sp.
KVSDYISPLLSFAAEH

SEQ ID NO: 5578 - protein, 14 aa, Mus sp.
DYVPPTANLDQKDK

SEQ ID NO: 5579 - protein, 18 aa, Mus sp.
ERLYLLAAPSAERSDWIQ

SEQ ID NO: 5580 - protein, 16 aa, Mus sp.
SARTVITPDPNLSIDQ

SEQ ID NO: 5581 - protein, 25 aa, Mus sp.
GPSAPATPAAEAKAAEAAASAYYNP

SEQ ID NO: 5582 - protein, 11 aa, Mus sp.
TIWVSPSPILE

SEQ ID NO: 5583 - protein, 15 aa, Mus sp.
LKRSYSSPDITQALQ

SEQ ID NO: 5584 - protein, 20 aa, Mus sp.
FEDYVELPPSVSQAAKSPPG

SEQ ID NO: 5585 - protein, 14 aa, Mus sp.
KFRFEEPVVLPDLS

SEQ ID NO: 5586 - protein, 16 aa, Mus sp.
EAINDYKGAVIVVSHD

SEQ ID NO: 5587 - protein, 18 aa, Mus sp.
GNPLNSVFVAPAVTPVKG

SEQ ID NO: 5588 - protein, 19 aa, Mus sp.
KIPEVDMARVVAPFMSNIP

SEQ ID NO: 5589 - protein, 15 aa, Mus sp.
AEEYLGMPVANAVIS

SEQ ID NO: 5590 - protein, 15 aa, Mus sp.
NVQFSSPLPGEAVKD

SEQ ID NO: 5591 - protein, 18 aa, Mus sp.
IVLQAAVPKSMKVKLQPP

SEQ ID NO: 5592 - protein, 15 aa, Mus sp.
FGNIYSTPLALQMLM

SEQ ID NO: 5593 - protein, 19 aa, Mus sp.
FEDYVELPPSVSQAAKSPP

SEQ ID NO: 5594 - protein, 16 aa, Mus sp.
KEFEFIESQTSSHRIN

SEQ ID NO: 5595 - protein, 15 aa, Mus sp.
TPWKAPIVWEGTYDT

SEQ ID NO: 5596 - protein, 17 aa, Mus sp.
DINAFVGAVSLTAADSN

SEQ ID NO: 5597 - protein, 14 aa, Mus sp.
DGDSYRSPWSNKYD

SEQ ID NO: 5598 - protein, 12 aa, Mus sp.
YEGYALPHAILR

SEQ ID NO: 5599 - protein, 15 aa, Mus sp.
SFFWNVAPGAESAVA

SEQ ID NO: 5600 - protein, 17 aa, Mus sp.
EAEEVYRNSMPASSFQQ

SEQ ID NO: 5601 - protein, 12 aa, Mus sp.
MYLSPLQQAVSD

SEQ ID NO: 5602 - protein, 17 aa, Mus sp.
DTKVVFLSPAVPEEPEA

SEQ ID NO: 5603 - protein, 14 aa, Mus sp.
RLEQPNVVISLSRT

SEQ ID NO: 5604 - protein, 17 aa, Mus sp.
RAKQIVWNGPVGVFEWE

SEQ ID NO: 5605 - protein, 18 aa, Mus sp.
GDSNFGAPSASVAAAPAP

SEQ ID NO: 5606 - protein, 15 aa, Mus sp.
ADKTVKGPDGLTALE

SEQ ID NO: 5607 - protein, 14 aa, Mus sp.
LSRFTSGVPSFVLD

SEQ ID NO: 5608 - protein, 13 aa, Mus sp.
TPEYLAPEVLEDN

SEQ ID NO: 5609 - protein, 18 aa, Mus sp.
IGDSNFGAPSASVAAAPA

SEQ ID NO: 5610 - protein, 14 aa, Mus sp.
SSKNVFLSPMSISS

SEQ ID NO: 5611 - protein, 14 aa, Mus sp.
PSYYTQPVPVPNAN

SEQ ID NO: 5612 - protein, 12 aa, Mus sp.
VSYYGPKTSPVQ

SEQ ID NO: 5613 - protein, 13 aa, Mus sp.
DQLEWQSNQPWEQ

SEQ ID NO: 5614 - protein, 17 aa, Mus sp.
TVLEMYKVHNPVPLIVG

SEQ ID NO: 5615 - protein, 24 aa, Mus sp.
WSFMGALSVVLPCLLCYLPATGCV

SEQ ID NO: 5616 - protein, 15 aa, Mus sp.
DTAAKFIGAGAATVG

SEQ ID NO: 5617 - protein, 17 aa, Mus sp.
NVMRIINEPTAAAIAYG

SEQ ID NO: 5618 - protein, 15 aa, Mus sp.
MDEAYVQPEPLGVVL

SEQ ID NO: 5619 - protein, 13 aa, Mus sp.
KGPAFVNPLIPEN

SEQ ID NO: 5620 - protein, 14 aa, Mus sp.
KRYMAPEVLDDSIN

SEQ ID NO: 5621 - protein, 15 aa, Mus sp.
TIEFRGPNGLLVYQG

SEQ ID NO: 5622 - protein, 14 aa, Mus sp.
GIPVYRFVLPANAF

SEQ ID NO: 5623 - protein, 15 aa, Mus sp.
SGVEWKGPQVSSSLN

SEQ ID NO: 5624 - protein, 13 aa, Mus sp.
GEFDYSGSQAIKA

SEQ ID NO: 5625 - protein, 16 aa, Mus sp.
YVPWNFHEPQPGQYEF

SEQ ID NO: 5626 - protein, 17 aa, Mus sp.
YVTQFHPPHIEIQMLKN

SEQ ID NO: 5627 - protein, 18 aa, Mus sp.
DHAISDLSMYNYIEMRAH

SEQ ID NO: 5628 - protein, 15 aa, Mus sp.
ADDYTTANARKLIDE

SEQ ID NO: 5629 - protein, 14 aa, Mus sp.
LPDYSAPNPIKVTH

SEQ ID NO: 5630 - protein, 14 aa, Mus sp.
QIDYTVPTVIAEEM

SEQ ID NO: 5631 - protein, 12 aa, Mus sp.
TENGYSYPVVSY

SEQ ID NO: 5632 - protein, 16 aa, Mus sp.
EELYMPPLVIKVIDHR

SEQ ID NO: 5633 - protein, 15 aa, Mus sp.
NVLRIINEPTAAAIA

SEQ ID NO: 5634 - protein, 16 aa, Mus sp.
DTVTISGPQAAVNEFV

SEQ ID NO: 5635 - protein, 22 aa, Mus sp.
KPAAAKPAATRPLAAAIRPVAT

SEQ ID NO: 5636 - protein, 16 aa, Mus sp.
GNMHYDTPDIRRFDPV

SEQ ID NO: 5637 - protein, 15 aa, Mus sp.
DSSKNVFLSPMSISS

SEQ ID NO: 5638 - protein, 14 aa, Mus sp.
EPVWRSEQAIGAIA

SEQ ID NO: 5639 - protein, 22 aa, Mus sp.
RPDAEYWNSQPEILERTRAELD

SEQ ID NO: 5640 - protein, 16 aa, Mus sp.
GPVTPLSPSVLPSLPQ

SEQ ID NO: 5641 - protein, 17 aa, Mus sp.
TTTVVHAPYPQPQPQPV

SEQ ID NO: 5642 - protein, 17 aa, Mus sp.
EEVNIKTAEAQLAYELQ

SEQ ID NO: 5643 - protein, 18 aa, Mus sp.
IGGDTHFDSAEPWTVQNE

SEQ ID NO: 5644 - protein, 21 aa, Mus sp.
YPNPTLDHYKEPSAIFQLPYE

SEQ ID NO: 5645 - protein, 17 aa, Mus sp.
EAPAAAEAPAAAEAPAA

SEQ ID NO: 5646 - protein, 19 aa, Mus sp.
MTFCKSNVINHFYCADPPL

SEQ ID NO: 5647 - protein, 18 aa, Mus sp.
VPSVIYTHPEVAWVGKSE

SEQ ID NO: 5648 - protein, 16 aa, Mus sp.
VPWNFHEPQPGQYEFS

SEQ ID NO: 5649 - protein, 12 aa, Mus sp.
IEGYVPSQADVA

SEQ ID NO: 5650 - protein, 16 aa, Mus sp.
LDDPIWRGPLPSNGVM

SEQ ID NO: 5651 - protein, 16 aa, Mus sp.
VVLYHRSPTANENQNL

SEQ ID NO: 5652 - protein, 15 aa, Mus sp.
VAWATGEPNFANDDE

SEQ ID NO: 5653 - protein, 13 aa, Mus sp.
GGLPDYSAPNPIK

SEQ ID NO: 5654 - protein, 8 aa, Mus sp.
SSIASFKD

SEQ ID NO: 5655 - protein, 18 aa, Mus sp.
EDITHTYKYPEGSPEERE

SEQ ID NO: 5656 - protein, 17 aa, Mus sp.
NDLQYAAPGGLIGVGTK

SEQ ID NO: 5657 - protein, 14 aa, Mus sp.
YEGYALPHAILRLD

SEQ ID NO: 5658 - protein, 15 aa, Mus sp.
DDIRSDWTNPEINKA

SEQ ID NO: 5659 - protein, 17 aa, Mus sp.
LSSEMNTSTVNSAREEL

SEQ ID NO: 5660 - protein, 16 aa, Mus sp.
GSVTYIAPPGNYDASD

SEQ ID NO: 5661 - protein, 15 aa, Mus sp.
GSVLWERPVAQDVAL

SEQ ID NO: 5662 - protein, 14 aa, Mus sp.
ETFHASQPSLTVDG

SEQ ID NO: 5663 - protein, 16 aa, Mus sp.
APTTAYKKTTPIEAAS

SEQ ID NO: 5664 - protein, 14 aa, Mus sp.
APQGSLGEYLFERL

SEQ ID NO: 5665 - protein, 18 aa, Mus sp.
VPDVQFKTPQISMSDIDL

SEQ ID NO: 5666 - protein, 14 aa, Mus sp.
AGPQWADPQISESN

SEQ ID NO: 5667 - protein, 17 aa, Mus sp.
FGKWKYEKPDGSPVFIA

SEQ ID NO: 5668 - protein, 15 aa, Mus sp.
LENPHQPASLEATDS

SEQ ID NO: 5669 - protein, 21 aa, Mus sp.
APSEERVYMVGKANSVFEDLS

SEQ ID NO: 5670 - protein, 14 aa, Mus sp.
EPPPAYEPPAPAPA

SEQ ID NO: 5671 - protein, 20 aa, Mus sp.
SKIETLTLAKNYIKSLTATI

SEQ ID NO: 5672 - protein, 16 aa, Mus sp.
SKEAFQEALAAAGDKL

SEQ ID NO: 5673 - protein, 16 aa, Mus sp.
AINDYKGAVIVVSHDA

SEQ ID NO: 5674 - protein, 14 aa, Mus sp.
FPIKWTAPEAALYG

SEQ ID NO: 5675 - protein, 14 aa, Mus sp.
LVLDFVTPTPLGTR

SEQ ID NO: 5676 - protein, 20 aa, Mus sp.
SPESPDQWSSSSPHSASDWS

SEQ ID NO: 5677 - protein, 13 aa, Mus sp.
ETFNTPAMYVAIQ

SEQ ID NO: 5678 - protein, 17 aa, Mus sp.
AFALQEQPVVNAVIDDA

SEQ ID NO: 5679 - protein, 13 aa, Mus sp.
IASFKDPKISTSL

SEQ ID NO: 5680 - protein, 18 aa, Mus sp.
DFLKKWETPSQNTAQLDQ

SEQ ID NO: 5681 - protein, 17 aa, Mus sp.
DLSQHATPLPTPAVLPG

SEQ ID NO: 5682 - protein, 18 aa, Mus sp.
DDEKVRVSYYGPKTSPVQ

SEQ ID NO: 5683 - protein, 16 aa, Mus sp.
EAPQATVFPKSPVLLG

SEQ ID NO: 5684 - protein, 17 aa, Mus sp.
YTPYYVAPEVLGPEKYD

SEQ ID NO: 5685 - protein, 15 aa, Mus sp.
EQEVLAPQVVLSLGG

SEQ ID NO: 5686 - protein, 18 aa, Mus sp.
ITDKFWGPSGAESVIGGV

SEQ ID NO: 5687 - protein, 14 aa, Mus sp.
DGYQMAQPVFAPKN

SEQ ID NO: 5688 - protein, 21 aa, Mus sp.
NGKLTGMAFRVPTPNVSVVDL

SEQ ID NO: 5689 - protein, 17 aa, Mus sp.
GPGGLWVWGAPAVAQLL

SEQ ID NO: 5690 - protein, 18 aa, Mus sp.
GKLLEAKGPVTDVAYSHD

SEQ ID NO: 5691 - protein, 16 aa, Mus sp.
DKRLEFEASQVLGTMD

SEQ ID NO: 5692 - protein, 14 aa, Mus sp.
SFFWNVAPGAESAV

SEQ ID NO: 5693 - protein, 17 aa, Mus sp.
VEPGNFIAATSLYSPER

SEQ ID NO: 5694 - protein, 19 aa, Mus sp.
LPDDINVYATTAANPKESS

SEQ ID NO: 5695 - protein, 21 aa, Mus sp.
RKGEQIYYAGPVNNPGLDVPQ

SEQ ID NO: 5696 - protein, 14 aa, Mus sp.
LDKDSFSDPYAHVS

SEQ ID NO: 5697 - protein, 18 aa, Mus sp.
NPLNSVFVAPAVTPVKGV

SEQ ID NO: 5698 - protein, 15 aa, Mus sp.
LEEQLGPVAEETRAR

SEQ ID NO: 5699 - protein, 14 aa, Mus sp.
DYLKWLFPTSMRSN

SEQ ID NO: 5700 - protein, 17 aa, Mus sp.
VGTKRYMAPEVLDDSIN

SEQ ID NO: 5701 - protein, 16 aa, Mus sp.
VYIFYGASIASLSASH

SEQ ID NO: 5702 - protein, 20 aa, Mus sp.
LEDPDGFSWPATLPSVYKQP

SEQ ID NO: 5703 - protein, 17 aa, Mus sp.
FAAEEFKVPAATSAIIT

SEQ ID NO: 5704 - protein, 15 aa, Mus sp.
VPSVIYTHPEVAWVG

SEQ ID NO: 5705 - protein, 17 aa, Mus sp.
EEWGPFKAPHANRFIFS

SEQ ID NO: 5706 - protein, 15 aa, Mus sp.
EEVEHWFYPQENIID

SEQ ID NO: 5707 - protein, 20 aa, Mus sp.
LIGRTWNDPSVQQDIKFLPF

SEQ ID NO: 5708 - protein, 17 aa, Mus sp.
GAVIFNFPGTRNEVIPM

SEQ ID NO: 5709 - protein, 18 aa, Mus sp.
TKKFRFEEPVVLPDLSDQ

SEQ ID NO: 5710 - protein, 16 aa, Mus sp.
LPPHVYSTPQPSLPPV

SEQ ID NO: 5711 - protein, 17 aa, Mus sp.
YGIPFAAPTALASRDGN

SEQ ID NO: 5712 - protein, 23 aa, Mus sp.
PGIDGIPGEKGNAGDIGGPGPPG

SEQ ID NO: 5713 - protein, 14 aa, Mus sp.
YPNSFSAPEQQRSA

SEQ ID NO: 5714 - protein, 12 aa, Mus sp.
ALPYDTPVPGYM

SEQ ID NO: 5715 - protein, 14 aa, Mus sp.
GNVYIHPTAKVAPS

SEQ ID NO: 5716 - protein, 18 aa, Mus sp.
GPGSAVSPYPSFNVSSDV

SEQ ID NO: 5717 - protein, 15 aa, Mus sp.
GNHYFYSPYPTKTQT

SEQ ID NO: 5718 - protein, 18 aa, Mus sp.
VGTARYMAPEVLESRMNL

SEQ ID NO: 5719 - protein, 19 aa, Mus sp.
GVEAARDNMFSGSKINYTE

SEQ ID NO: 5720 - protein, 17 aa, Mus sp.
RPDAEYWNSQPEILERT

SEQ ID NO: 5721 - protein, 16 aa, Mus sp.
DIRSDWTNPEINKAVL

SEQ ID NO: 5722 - protein, 15 aa, Mus sp.
APSWHASVPTRAGPD

SEQ ID NO: 5723 - protein, 17 aa, Mus sp.
EKEDRRYNPPIIHQGFQ

SEQ ID NO: 5724 - protein, 17 aa, Mus sp.
LQKTQYISPNLNPNDVT

SEQ ID NO: 5725 - protein, 15 aa, Mus sp.
KIGEHTPSALAIMEN

SEQ ID NO: 5726 - protein, 15 aa, Mus sp.
INPDNVATPIAASLG

SEQ ID NO: 5727 - protein, 16 aa, Mus sp.
ITGVDFIGSTVGLAKV

SEQ ID NO: 5728 - protein, 15 aa, Mus sp.
KQIDYTVPTVIAEEM

SEQ ID NO: 5729 - protein, 16 aa, Mus sp.
LNLEYHSSMIADAVKK

SEQ ID NO: 5730 - protein, 16 aa, Mus sp.
DGYPVLYPTGWSSSDN

SEQ ID NO: 5731 - protein, 15 aa, Mus sp.
TVTPWKAPIVWEGTY

SEQ ID NO: 5732 - protein, 16 aa, Mus sp.
QPVVIYSSPGVILPKQ

SEQ ID NO: 5733 - protein, 11 aa, Mus sp.
TPWKAPIVWEG

SEQ ID NO: 5734 - protein, 14 aa, Mus sp.
GDLAIYAAAVPVSL

SEQ ID NO: 5735 - protein, 13 aa, Mus sp.
EQIAVVAPEPLLT

SEQ ID NO: 5736 - protein, 11 aa, Mus sp.
LPDYSAPNPIK

SEQ ID NO: 5737 - protein, 18 aa, Mus sp.
KPGTTVEYLAPWANQIDM

SEQ ID NO: 5738 - protein, 16 aa, Mus sp.
TWSDAAAPFAGLSTDQ

SEQ ID NO: 5739 - protein, 22 aa, Mus sp.
VPPAGGGDPEAPAPAPAAERPP

SEQ ID NO: 5740 - protein, 18 aa, Mus sp.
IFSPYFINGQQLHLSEDM

SEQ ID NO: 5741 - protein, 20 aa, Mus sp.
DLYKSFVQNYPVVSIEDPFD

SEQ ID NO: 5742 - protein, 17 aa, Mus sp.
WGIDPYDQPNAIYIERH

SEQ ID NO: 5743 - protein, 16 aa, Mus sp.
EEWGPFKAPHANRFIF

SEQ ID NO: 5744 - protein, 13 aa, Mus sp.
GNSEFDPPGPNVA

SEQ ID NO: 5745 - protein, 15 aa, Mus sp.
LEKAVYQGPGSSPVK

SEQ ID NO: 5746 - protein, 12 aa, Mus sp.
MKNKELIPLAFF

SEQ ID NO: 5747 - protein, 16 aa, Mus sp.
YTLWKEFFFSVPAGPP

SEQ ID NO: 5748 - protein, 16 aa, Mus sp.
EEKYTVIYPYTARDQD

SEQ ID NO: 5749 - protein, 17 aa, Mus sp.
HNLFEDNMALPSESVSS

SEQ ID NO: 5750 - protein, 15 aa, Mus sp.
LPYKSPGINVDSSYK

SEQ ID NO: 5751 - protein, 17 aa, Mus sp.
KEVLDYSTPTTNGTPEA

SEQ ID NO: 5752 - protein, 15 aa, Mus sp.
YIEGYVPSQADVAVF

SEQ ID NO: 5753 - protein, 17 aa, Mus sp.
EGEMTLKSALALAVKVL

SEQ ID NO: 5754 - protein, 16 aa, Mus sp.
KKFRFEEPVVLPDLSD

SEQ ID NO: 5755 - protein, 15 aa, Mus sp.
KGPAFVNPLIPENKE

SEQ ID NO: 5756 - protein, 20 aa, Mus sp.
YTWSDAAAPFAGLSTDQTLR

SEQ ID NO: 5757 - protein, 12 aa, Mus sp.
VEPYEVHNPVPL

SEQ ID NO: 5758 - protein, 17 aa, Mus sp.
KELSFAPPMSDRSGDGI

SEQ ID NO: 5759 - protein, 23 aa, Mus sp.
NPEPPPPRSHYSNIEANESEEVR

SEQ ID NO: 5760 - protein, 17 aa, Mus sp.
EGPEASTPMPSPSPSPS

SEQ ID NO: 5761 - protein, 16 aa, Mus sp.
KLGMLTIGVDLQGVLM

SEQ ID NO: 5762 - protein, 30 aa, Mus sp.; identical to SEQ ID NO: 2486

SEQ ID NO: 5763 - protein, 15 aa, Mus sp.
YGYHVNSPQVWSEPS

SEQ ID NO: 5764 - protein, 14 aa, Mus sp.
SPYINPIIPFTGPI

SEQ ID NO: 5765 - protein, 17 aa, Mus sp.
VGTIRYMAPEVLEGAVN

SEQ ID NO: 5766 - protein, 26 aa, Mus sp.
KVIPELNGKLTGMAFRVPTPNVSVVD

SEQ ID NO: 5767 - protein, 15 aa, Mus sp.
AYWEVKYPFPLSNRD

SEQ ID NO: 5768 - protein, 22 aa, Mus sp.
MEKIQASVATNPIITPVAQENQ

SEQ ID NO: 5769 - protein, 19 aa, Mus sp.
VNGKKFTAPHILIATGGVP

SEQ ID NO: 5770 - protein, 21 aa, Mus sp.
QDPEDHTVSFVQPNGAIFEPS

SEQ ID NO: 5771 - protein, 14 aa, Mus sp.
LRDWESPYSHDLDT

SEQ ID NO: 5772 - protein, 15 aa, Mus sp.
TPRDYYFALAHTVRD

SEQ ID NO: 5773 - protein, 15 aa, Mus sp.
TKVVFLSPAVPEEPE

SEQ ID NO: 5774 - protein, 15 aa, Mus sp.
SVPATFAPSPTPAVV

SEQ ID NO: 5775 - protein, 18 aa, Mus sp.
FAAEEFKVPAATSAIITN

SEQ ID NO: 5776 - protein, 15 aa, Mus sp.
GEVEWKGPWSDSSYE

SEQ ID NO: 5777 - protein, 14 aa, Mus sp.
WSDAAAPFAGLSTD

SEQ ID NO: 5778 - protein, 17 aa, Mus sp.
APVEGASPTSISAVDGL

SEQ ID NO: 5779 - protein, 17 aa, Mus sp.
TPDPNTAYASYPSASVE

SEQ ID NO: 5780 - protein, 15 aa, Mus sp.
LEEIYLFSLPIKESE

SEQ ID NO: 5781 - protein, 17 aa, Mus sp.
DSRTNTAYVGSAILSEE

SEQ ID NO: 5782 - protein, 16 aa, Mus sp.
NLDYVATSIHEAVTKI

SEQ ID NO: 5783 - protein, 17 aa, Mus sp.
IEQFVYSSPHDNKSWEM

SEQ ID NO: 5784 - protein, 16 aa, Mus sp.
LLEAKGPVTDVAYSHD

SEQ ID NO: 5785 - protein, 14 aa, Mus sp.
SNSYGIPEPAHAYA

SEQ ID NO: 5786 - protein, 14 aa, Mus sp.
GEFDYSGSQAIKAL

SEQ ID NO: 5787 - protein, 17 aa, Mus sp.
AARDNMFSGSKINYTEN

SEQ ID NO: 5788 - protein, 17 aa, Mus sp.
EQLPNVQVEGPTPNRPR

SEQ ID NO: 5789 - protein, 15 aa, Mus sp.
LDSQYRASAPNSHVP

SEQ ID NO: 5790 - protein, 23 aa, Mus sp.
IQEMEKEDRRYNPPIIHQGFQDT

SEQ ID NO: 5791 - protein, 16 aa, Mus sp.
IEHLYKNPQAHIEGNM

SEQ ID NO: 5792 - protein, 14 aa, Mus sp.
LELEEPPLVLAAAN

SEQ ID NO: 5793 - protein, 16 aa, Mus sp.
YQMYGGPVVLVAHSMG

SEQ ID NO: 5794 - protein, 21 aa, Mus sp.
EMEKEDRRYNPPIIHQGFQDT

SEQ ID NO: 5795 - protein, 17 aa, Mus sp.
RVKQYYEVPIAMKSVFD

SEQ ID NO: 5796 - protein, 14 aa, Mus sp.
GIFKGPTAENAEYL

SEQ ID NO: 5797 - protein, 14 aa, Mus sp.
LVQTYVGAISNGSL

SEQ ID NO: 5798 - protein, 15 aa, Mus sp.
YYNEVHSPSVAVEMG

SEQ ID NO: 5799 - protein, 15 aa, Mus sp.
ETVAYLQAHALTTEG

SEQ ID NO: 5800 - protein, 18 aa, Mus sp.
APVEGASPTSISAVDGLT

SEQ ID NO: 5801 - protein, 15 aa, Mus sp.
VELPPSVSQAATSPP

SEQ ID NO: 5802 - protein, 17 aa, Mus sp.
TKVEPYEVHNPVPLIVG

SEQ ID NO: 5803 - protein, 15 aa, Mus sp.
NPLNSVFVAPAVTPV

SEQ ID NO: 5804 - protein, 14 aa, Mus sp.
QLEALVGPEANVGP

SEQ ID NO: 5805 - protein, 16 aa, Mus sp.
KFDEWVAPTPEVADMQ

SEQ ID NO: 5806 - protein, 14 aa, Mus sp.
YDPIISPEVAASFG

SEQ ID NO: 5807 - protein, 16 aa, Mus sp.
EPPSDLDFFSPRPVPA

SEQ ID NO: 5808 - protein, 18 aa, Mus sp.
GELTYENVQVSPVPGGPP

SEQ ID NO: 5809 - protein, 16 aa, Mus sp.
RITPSYVAFTPEGERL

SEQ ID NO: 5810 - protein, 12 aa, Mus sp.
DEATRYLAPTIL

SEQ ID NO: 5811 - protein, 30 aa, Mus sp.; identical to SEQ ID NO: 3000

SEQ ID NO: 5812 - protein, 18 aa, Mus sp.
FGNSEFDPPGPNVATTTV

SEQ ID NO: 5813 - protein, 13 aa, Mus sp.
YYRGAQAAIVVYD

SEQ ID NO: 5814 - protein, 18 aa, Mus sp.
APISSHTAPRPNPTPALP

SEQ ID NO: 5815 - protein, 14 aa, Listeria monocytogenes
IAVTAFAAPTIASA

SEQ ID NO: 5816 - protein, 16 aa, Mus sp.
GPASEWTFSTPEGVPG

SEQ ID NO: 5817 - protein, 16 aa, Mus sp.
VVDNVSSPETIVVFNG

SEQ ID NO: 5818 - protein, 15 aa, Mus sp.
LRLQVESPQVHWEPT

SEQ ID NO: 5819 - protein, 22 aa, Mus sp.
INPDEAVAYGAAVQAAILSGDK

SEQ ID NO: 5820 - protein, 20 aa, Mus sp.
EPPPAYEPPAPAPAPLPPPS

SEQ ID NO: 5821 - protein, 13 aa, Mus sp.
YQMYGGPVVLVAH

SEQ ID NO: 5822 - protein, 15 aa, Mus sp.
DFITMNPSVVQRAFG

SEQ ID NO: 5823 - protein, 22 aa, Listeria monocytogenes
RDNYLFQLYEATGTPIHPMSPF

SEQ ID NO: 5824 - protein, 19 aa, Mus sp.
SPGILQASPTPLLAAAAPA

SEQ ID NO: 5825 - protein, 17 aa, Mus sp.
KPVPAAPVPSPVAPAPV

SEQ ID NO: 5826 - protein, 12 aa, Mus sp.
DYVATSIHEAVT

SEQ ID NO: 5827 - protein, 17 aa, Mus sp.
RPALAYESVVAQEGNPI

SEQ ID NO: 5828 - protein, 16 aa, Mus sp.
ELDQLFSGPLPGRLPV

SEQ ID NO: 5829 - protein, 19 aa, Mus sp.
VTEDNVFEAPTLVKVFKQP

SEQ ID NO: 5830 - protein, 17 aa, Mus sp.
RFGPYYTEPVIAGLDPK

SEQ ID NO: 5831 - protein, 15 aa, Mus sp.
EKVIVDFSSPNIAKE

SEQ ID NO: 5832 - protein, 12 aa, Mus sp.
IVYWMTSQPSDA

SEQ ID NO: 5833 - protein, 19 aa, Mus sp.
KLTGMAFRVPTPNVSVVDL

SEQ ID NO: 5834 - protein, 26 aa, Mus sp.
DYKDESGFPKPPSYNVATTLPSYDEA

SEQ ID NO: 5835 - protein, 17 aa, Mus sp.
EPLSTVTAPDSPEAAEQ

SEQ ID NO: 5836 - protein, 15 aa, Mus sp.
VDFDIAGPSIRGALV

SEQ ID NO: 5837 - protein, 15 aa, Mus sp.
FGPYYTEPVIAGLDP

SEQ ID NO: 5838 - protein, 17 aa, Mus sp.
PLKEDNWSLPNRAVEPQ

SEQ ID NO: 5839 - protein, 16 aa, Mus sp.
VKSKYKASIAALEAKI

SEQ ID NO: 5840 - protein, 14 aa, Mus sp.
KPTVTVVSPLPNDS

SEQ ID NO: 5841 - protein, 15 aa, Mus sp.
AEEYEFLTPMEEAPK

SEQ ID NO: 5842 - protein, 15 aa, Mus sp.
LPTTFQGATASTSYG

SEQ ID NO: 5843 - protein, 15 aa, Mus sp.
IVYWMTSQPSDAVRF

SEQ ID NO: 5844 - protein, 15 aa, Mus sp.
IDWREPEGKEVWDYV

SEQ ID NO: 5845 - protein, 13 aa, Mus sp.
RVPTPNVSVVDLT

SEQ ID NO: 5846 - protein, 15 aa, Mus sp.
IWRDYVPPTANLDQK

SEQ ID NO: 5847 - protein, 15 aa, Mus sp.
GQNAWFLPAQADIVA

SEQ ID NO: 5848 - protein, 16 aa, Mus sp.
STDYGNFLANEASPLT

SEQ ID NO: 5849 - protein, 13 aa, Mus sp.
IDYTVPTVIAEEM

SEQ ID NO: 5850 - protein, 9 aa, Mus sp.
FVLPANAFA

SEQ ID NO: 5851 - protein, 15 aa, Mus sp.
LEHSNDPSAIMAPFY

SEQ ID NO: 5852 - protein, 12 aa, Mus sp.
EQEVLAPQVVLS

SEQ ID NO: 5853 - protein, 16 aa, Mus sp.
APAQMAYPTAYPSFPG

SEQ ID NO: 5854 - protein, 18 aa, Mus sp.
LNVMRIINEPTAAAIAYG

SEQ ID NO: 5855 - protein, 17 aa, Mus sp.
DSVTTDHISPAGNIARN

SEQ ID NO: 5856 - protein, 11 aa, Mus sp.
PIITPVAQENQ

SEQ ID NO: 5857 - protein, 15 aa, Mus sp.
APAPAEAPAAAEAPA

SEQ ID NO: 5858 - protein, 19 aa, Mus sp.
DVKKPAAAPAPAPAPAPAP

SEQ ID NO: 5859 - protein, 16 aa, Mus sp.
TPSYYTTSDAVISTET

SEQ ID NO: 5860 - protein, 16 aa, Mus sp.
TAKGLFRAAVPSGAST

SEQ ID NO: 5861 - protein, 18 aa, Mus sp.
LKWKALYTDPKSSETAAF

SEQ ID NO: 5862 - protein, 14 aa, Mus sp.
VRVDEYDYSKPIQG

SEQ ID NO: 5863 - protein, 15 aa, Mus sp.
LALPYDTPVPGYMNN

SEQ ID NO: 5864 - protein, 22 aa, Mus sp.
EPSPVSETVVTPEAAPEKNPVD

SEQ ID NO: 5865 - protein, 16 aa, Mus sp.
EAPAAAEAPAAAEAPA

SEQ ID NO: 5866 - protein, 12 aa, Mus sp.
NSYPVYLMEQQN

SEQ ID NO: 5867 - protein, 17 aa, Mus sp.
GIYEYYEPRLSVLPSPV

SEQ ID NO: 5868 - protein, 13 aa, Mus sp.
TAYASYPSASVEN

SEQ ID NO: 5869 - protein, 13 aa, Mus sp.
FVAPAVTPVKGVL

SEQ ID NO: 5870 - protein, 18 aa, Mus sp.
GYAVYETPTAHNGAKNPR

SEQ ID NO: 5871 - protein, 19 aa, Mus sp.
EEKPVPAAPVPSPVAPAPV

SEQ ID NO: 5872 - protein, 18 aa, Mus sp.
IDNSKEFEFIESQTSSHR

SEQ ID NO: 5873 - protein, 12 aa, Mus sp.
IFYGASIASLSA

SEQ ID NO: 5874 - protein, 29 aa, Mus sp.
NVDPFKAVDTNRASMGQASPESKGFTDLL

SEQ ID NO: 5875 - protein, 18 aa, Mus sp.
MRTSVDQNVYPSQNGTPN

SEQ ID NO: 5876 - protein, 17 aa, Mus sp.
LDLLDLAPEPRYAHIPV

SEQ ID NO: 5877 - protein, 17 aa, Mus sp.
IILENYAYPGVLLIGTD

SEQ ID NO: 5878 - protein, 20 aa, Mus sp.
IGDSNFGAPSASVAAAPAPA

SEQ ID NO: 5879 - protein, 15 aa, Mus sp.
DMDGEWEAPQIANPK

SEQ ID NO: 5880 - protein, 16 aa, Mus sp.
FELPYVSVTSLRSQEY

SEQ ID NO: 5881 - protein, 21 aa, Listeria monocytogenes
SSYPGSDETPPVVNPGETNPP

SEQ ID NO: 5882 - protein, 14 aa, Mus sp.
GQVYAFPSSQSVTE

SEQ ID NO: 5883 - protein, 15 aa, Mus sp.
SVASQFQMHSTPVRI

SEQ ID NO: 5884 - protein, 14 aa, Mus sp.
YVTQFHPPHIEIQM

SEQ ID NO: 5885 - protein, 10 aa, Mus sp.
LDYYDSPSVN

SEQ ID NO: 5886 - protein, 19 aa, Mus sp.
NPTDEYLDAMMNEAPGPIN

SEQ ID NO: 5887 - protein, 16 aa, Mus sp.
TPPPAAAPIPAPSTEE

SEQ ID NO: 5888 - protein, 17 aa, Mus sp.
EPPPAYEPPAPAPAPLP

SEQ ID NO: 5889 - protein, 15 aa, Mus sp.
NVDPFKAVDTNRASM

SEQ ID NO: 5890 - protein, 19 aa, Mus sp.
IGDSNFGAPSASVAAAPAP

SEQ ID NO: 5891 - protein, 17 aa, Mus sp.
WSDAAAPFAGLSTDQTL

SEQ ID NO: 5892 - protein, 16 aa, Mus sp.
GTPEYLAPEVLEDNDY

SEQ ID NO: 5893 - protein, 14 aa, Mus sp.
LSYNEPLSLKTEAF

SEQ ID NO: 5894 - protein, 20 aa, Mus sp.
SANAIYSLAARPLPMPKLPP

SEQ ID NO: 5895 - protein, 13 aa, Mus sp.
DLWGPGARVAADS

SEQ ID NO: 5896 - protein, 19 aa, Mus sp.
TPAYTIPFYTPIPNGLYPS

SEQ ID NO: 5897 - protein, 15 aa, Mus sp.
RNYEYYASHVPESVK

SEQ ID NO: 5898 - protein, 30 aa, Mus sp.; identical to SEQ ID NO: 2463

SEQ ID NO: 5899 - protein, 14 aa, Mus sp.
TLPDFHVPEITIPE

SEQ ID NO: 5900 - protein, 17 aa, Mus sp.
IDDVIYHEAAVRQAGAE

SEQ ID NO: 5901 - protein, 13 aa, Mus sp.
SSIYYISSTIAYA

SEQ ID NO: 5902 - protein, 14 aa, Mus sp.
VVIEVFTPVVQRIL

SEQ ID NO: 5903 - protein, 13 aa, Mus sp.
LALPYDTPVPGYM

SEQ ID NO: 5904 - protein, 14 aa, Mus sp.
GDSNFGAPSASVAA

SEQ ID NO: 5905 - protein, 14 aa, Mus sp.
SDVIHAPLPSPVDK

SEQ ID NO: 5906 - protein, 17 aa, Mus sp.
YPNSFSAPEQQRSALEH

SEQ ID NO: 5907 - protein, 15 aa, Mus sp.
APAAAEAPAAAEAPA

SEQ ID NO: 5908 - protein, 18 aa, Mus sp.
NRITPSYVAFTPEGERLI

SEQ ID NO: 5909 - protein, 17 aa, Mus sp.
NHIEVWERPLSNLAWAV

SEQ ID NO: 5910 - protein, 15 aa, Mus sp.
LLYNVPAVAEEIQDE

SEQ ID NO: 5911 - protein, 19 aa, Mus sp.
TPSAAYLWVGAGASEAEKT

SEQ ID NO: 5912 - protein, 13 aa, Mus sp.
FDIFYTAPQPGKY

SEQ ID NO: 5913 - protein, 13 aa, Mus sp.
VKDGYQMAQPVFA

SEQ ID NO: 5914 - protein, 19 aa, Mus sp.
HDGDSVVFAGPAGNSVETR

SEQ ID NO: 5915 - protein, 16 aa, Mus sp.
SLLYNVPAVAEEIQDE

SEQ ID NO: 5916 - protein, 20 aa, Mus sp.
HDGDSVVFAGPAGNSVETRG

SEQ ID NO: 5917 - protein, 16 aa, Mus sp.
SQELVRAPTAALSPEP

SEQ ID NO: 5918 - protein, 16 aa, Mus sp.
GKITTDYNSPEAGNIF

SEQ ID NO: 5919 - protein, 12 aa, Mus sp.
KLQMEAPHIIVG

SEQ ID NO: 5920 - protein, 24 aa, Mus sp.
LDPAGPNFEYAEAPSRLSPDDADF

SEQ ID NO: 5921 - protein, 15 aa, Mus sp.
NLLLQSPGVLTAARE

SEQ ID NO: 5922 - protein, 14 aa, Mus sp.
NIPYFETSAKEAIN

SEQ ID NO: 5923 - protein, 18 aa, Mus sp.
GPDFEYVSPIPAWARDDW

SEQ ID NO: 5924 - protein, 12 aa, Mus sp.
VPIVEPEILPDG

SEQ ID NO: 5925 - protein, 13 aa, Mus sp.
DQLFSGPLPGRLP

SEQ ID NO: 5926 - protein, 17 aa, Mus sp.
EEKYTVIYPYTARDQDE

SEQ ID NO: 5927 - protein, 13 aa, Mus sp.
AVDVFFPPEAQND

SEQ ID NO: 5928 - protein, 23 aa, Mus sp.
DESGFPKPPSYNVATTLPSYDEA

SEQ ID NO: 5929 - protein, 16 aa, Mus sp.
FVAWATGEPNFANDDE

SEQ ID NO: 5930 - protein, 19 aa, Mus sp.
LPPHVYSTPQPSLPPVQPS

SEQ ID NO: 5931 - protein, 19 aa, Mus sp.
APMPPIIHAPRINVVPMPP

SEQ ID NO: 5932 - protein, 30 aa, Mus sp.; identical to SEQ ID NO: 1359

SEQ ID NO: 5933 - protein, 17 aa, Mus sp.
APPAGSLYSSPVNSSAP

SEQ ID NO: 5934 - protein, 17 aa, Mus sp.
GNPLNSVFVAPAVTPVK

SEQ ID NO: 5935 - protein, 15 aa, Mus sp.
ALVVTTPQAVSIGDV

SEQ ID NO: 5936 - protein, 18 aa, Mus sp.
NGKTELNYKNTEPVLDSD

SEQ ID NO: 5937 - protein, 19 aa, Mus sp.
ATITVYSFPESVELRPLPA

SEQ ID NO: 5938 - protein, 17 aa, Mus sp.
TVIHFNNPKVQASLAAN

SEQ ID NO: 5939 - protein, 14 aa, Mus sp.
EQEVLAPQVVLSLG

SEQ ID NO: 5940 - protein, 15 aa, Mus sp.
TENGYSYPVVSYWVD

SEQ ID NO: 5941 - protein, 15 aa, Mus sp.
EDYVELPPSVSQAAK

SEQ ID NO: 5942 - protein, 17 aa, Mus sp.
GIDPYDQPNAIYIERHE

SEQ ID NO: 5943 - protein, 19 aa, Mus sp.
GKLLEAKGPVTDVAYSHDG

SEQ ID NO: 5944 - protein, 13 aa, Mus sp.
TVHWVAPRAPITG

SEQ ID NO: 5945 - protein, 15 aa, Mus sp.
IEEIEVAPPKAHEVR

SEQ ID NO: 5946 - protein, 14 aa, Mus sp.
YEWAPPVQNQALAR

SEQ ID NO: 5947 - protein, 15 aa, Mus sp.
ALPYDTPVPGYMNNT

SEQ ID NO: 5948 - protein, 15 aa, Mus sp.
AAPASAPTPSTPAPT

SEQ ID NO: 5949 - protein, 16 aa, Mus sp.
GYGPYSGAYPAGTQVV

SEQ ID NO: 5950 - protein, 14 aa, Mus sp.
MDGEWEAPQIANPK

SEQ ID NO: 5951 - protein, 17 aa, Mus sp.
TPENEDLHAATVNPDPS

SEQ ID NO: 5952 - protein, 16 aa, Mus sp.
AKVELVPPTPAEIPTA

SEQ ID NO: 5953 - protein, 18 aa, Mus sp.
DGTVIHFNNPKVQASLSA

SEQ ID NO: 5954 - protein, 18 aa, Mus sp.
IEVDQIYHLASPASPPNY

SEQ ID NO: 5955 - protein, 13 aa, Mus sp.
DKEFHAPLIIDEN

SEQ ID NO: 5956 - protein, 14 aa, Mus sp.
MRYFETAVSRPGLE

SEQ ID NO: 5957 - protein, 17 aa, Mus sp.
VPPSVSPSPATAFSGPP

SEQ ID NO: 5958 - protein, 16 aa, Mus sp.
TRPHWLEPTIYSSEED

SEQ ID NO: 5959 - protein, 17 aa, Mus sp.
GGKDFNMPLTISSLKDG

SEQ ID NO: 5960 - protein, 17 aa, Mus sp.
KAVDVFFPPEAQNDFPV

SEQ ID NO: 5961 - protein, 16 aa, Mus sp.
DPYDQPNAIYIERHEP

SEQ ID NO: 5962 - protein, 25 aa, Mus sp.
TPARAPETRSQVTPSVPSEALDDST

SEQ ID NO: 5963 - protein, 14 aa, Mus sp.
LAWNAPAVLQKPYN

SEQ ID NO: 5964 - protein, 15 aa, Mus sp.
LSLKYHFVTPLTSMV

SEQ ID NO: 5965 - protein, 21 aa, Mus sp.
LNGKLTGMAFRVPTPNVSVVD

SEQ ID NO: 5966 - protein, 13 aa, Mus sp.
WTYNPAAVSKVAP

SEQ ID NO: 5967 - protein, 17 aa, Mus sp.
VDLPNYSSPNALVLNTK

SEQ ID NO: 5968 - protein, 12 aa, Mus sp.
VDFIGSTVGLAK

SEQ ID NO: 5969 - protein, 17 aa, Mus sp.
GSVHTYVGGLPEVSVIS

SEQ ID NO: 5970 - protein, 16 aa, Mus sp.
SPVSETVVTPEAAPEK

SEQ ID NO: 5971 - protein, 16 aa, Mus sp.
IEGYVPSQADVAVFEA

SEQ ID NO: 5972 - protein, 19 aa, Mus sp.
IQGGDFTRGDGTGGKSIYG

SEQ ID NO: 5973 - protein, 17 aa, Mus sp.
FKQETLPSNSNESHDHM

SEQ ID NO: 5974 - protein, 19 aa, Mus sp.
EDFLKKWETPSQNTAQLDQ

SEQ ID NO: 5975 - protein, 19 aa, Mus sp.
HPDKGGSPYIAAKINEAKD

SEQ ID NO: 5976 - protein, 15 aa, Mus sp.
SEEEYSAPLPTPAPS

SEQ ID NO: 5977 - protein, 16 aa, Mus sp.
AVKSKYKASIAALEAK

SEQ ID NO: 5978 - protein, 16 aa, Mus sp.
ATEEKYHEALAKGDVT

SEQ ID NO: 5979 - protein, 17 aa, Mus sp.
KPWNQYRLPKTLIPDSY

SEQ ID NO: 5980 - protein, 17 aa, Mus sp.
NPTDAYLDAMMNEAPGP

SEQ ID NO: 5981 - protein, 17 aa, Mus sp.
WQPLTWTSSQPSGITVE

SEQ ID NO: 5982 - protein, 15 aa, Mus sp.
KWKALYTDPKSSETA

SEQ ID NO: 5983 - protein, 20 aa, Mus sp.
DLPKNWDWRNVNGVNYASVT

SEQ ID NO: 5984 - protein, 14 aa, Mus sp.
QKAMFDHLSYLLEN

SEQ ID NO: 5985 - protein, 15 aa, Mus sp.
ADFHYAASKALRVPA

SEQ ID NO: 5986 - protein, 16 aa, Mus sp.
LKPVWYSPKVFIEGAD

SEQ ID NO: 5987 - protein, 13 aa, Mus sp.
VELPPSVSQAATS

SEQ ID NO: 5988 - protein, 17 aa, Mus sp.
MPEMHFKAPKVSLPDVD

SEQ ID NO: 5989 - protein, 14 aa, Mus sp.
ADDIVGPVTHEIFE

SEQ ID NO: 5990 - protein, 16 aa, Mus sp.
IFGIHHNPSVWPDPEV

SEQ ID NO: 5991 - protein, 16 aa, Mus sp.
SFFWNVAPGAESAVAS

SEQ ID NO: 5992 - protein, 16 aa, Mus sp.
TEDNVFEAPTLVKVFK

SEQ ID NO: 5993 - protein, 12 aa, Mus sp.
LVLDFVTPTPLG

SEQ ID NO: 5994 - protein, 14 aa, Mus sp.
TVIHFNNPKVQASL

SEQ ID NO: 5995 - protein, 21 aa, Mus sp.
SEIDLKGIPVYRFVLPANAFA

SEQ ID NO: 5996 - protein, 16 aa, Mus sp.
DGDSVVFAGPAGNSVE

SEQ ID NO: 5997 - protein, 13 aa, Mus sp.
IDPYDQPNAIYIE

SEQ ID NO: 5998 - protein, 16 aa, Mus sp.
LLAETVAPAVRGANPH

SEQ ID NO: 5999 - protein, 15 aa, Mus sp.
LELEEPPLVLAAANV

SEQ ID NO: 6000 - protein, 15 aa, Mus sp.
SPPPGGYGQPSVLPG

SEQ ID NO: 6001 - protein, 17 aa, Mus sp.
NPKAEVARAQAALAVNI

SEQ ID NO: 6002 - protein, 17 aa, Mus sp.
GPKVNVEAPNVNMEGLG

SEQ ID NO: 6003 - protein, 15 aa, Mus sp.
EEEYYAEPGVTEAEP

SEQ ID NO: 6004 - protein, 20 aa, Mus sp.
EDGELTYENVQVSPVPGGPP

SEQ ID NO: 6005 - protein, 16 aa, Mus sp.
QASVATNPIITPVAQE

SEQ ID NO: 6006 - protein, 19 aa, BOVIN
APSAVPDAAGPTPSAAGPP

SEQ ID NO: 6007 - protein, 16 aa, Mus sp.
KERASFITPVPGGVGP

SEQ ID NO: 6008 - protein, 15 aa, Mus sp.
SFVQNYPVVSIEDPF

SEQ ID NO: 6009 - protein, 17 aa, Mus sp.
YPNTPYISPVASYSGQP

SEQ ID NO: 6010 - protein, 33 aa, Mus sp.; identical to SEQ ID NO: 2080

SEQ ID NO: 6011 - protein, 16 aa, Mus sp.
DPTTAFQAPDVGQALL

SEQ ID NO: 6012 - protein, 16 aa, Mus sp.
VYIPTYTKPNPNQIIS

SEQ ID NO: 6013 - protein, 13 aa, Mus sp.
TPDYIAPEILQGL

SEQ ID NO: 6014 - protein, 26 aa, Mus sp.
IPISKVKDVYVITDQIPVFVTMSQKN

SEQ ID NO: 6015 - protein, 15 aa, Mus sp.
LSLLYKVPYVAQEIQ

SEQ ID NO: 6016 - protein, 15 aa, Mus sp.
ASVATNPIITPVAQE

SEQ ID NO: 6017 - protein, 13 aa, Mus sp.
LSYREPDPEDAVG

SEQ ID NO: 6018 - protein, 15 aa, Mus sp.
LDDFEAGTATAAPPG

SEQ ID NO: 6019 - protein, 25 aa, Mus sp.
TGPDGKGMNPPSYYTQPVPVPNANA

SEQ ID NO: 6020 - protein, 16 aa, Mus sp.
FNPGDASGPEAAGSPP

SEQ ID NO: 6021 - protein, 16 aa, Mus sp.
GFQAYDFPAITTAQYS

SEQ ID NO: 6022 - protein, 23 aa, Mus sp.
TPDPNTAYASYPSASVENYQQPP

SEQ ID NO: 6023 - protein, 19 aa, Mus sp.
VDFVAWATGEPNFANDDEN

SEQ ID NO: 6024 - protein, 14 aa, Mus sp.
FYQHPNLMRALGMH

SEQ ID NO: 6025 - protein, 15 aa, Mus sp.
FQFGYNTGVINAPET

SEQ ID NO: 6026 - protein, 17 aa, Mus sp.
TSSLAAPTVEAAASAPA

SEQ ID NO: 6027 - protein, 19 aa, Mus sp.
ITRDLKWGTPVPLEGFEDK

SEQ ID NO: 6028 - protein, 17 aa, Mus sp.
VTEDNVFEAPTLVKVFK

SEQ ID NO: 6029 - protein, 14 aa, Mus sp.
YIEGYVPSQADVAV

SEQ ID NO: 6030 - protein, 15 aa, Mus sp.
IGDSNFGAPSASVAA

SEQ ID NO: 6031 - protein, 18 aa, Mus sp.
SAVKSKYKASIAALEAKI

SEQ ID NO: 6032 - protein, 19 aa, Mus sp.
EEVGEYRQPSGGSVPVSPG

SEQ ID NO: 6033 - protein, 14 aa, Mus sp.
SQPLLLGIACNETS

SEQ ID NO: 6034 - protein, 18 aa, Mus sp.
LPPHVYSTPQPSLPPVQP

SEQ ID NO: 6035 - protein, 14 aa, Mus sp.
ISVAVATPRGLVVP

SEQ ID NO: 6036 - protein, 14 aa, Mus sp.
QDAYHFFSPEPLNS

SEQ ID NO: 6037 - protein, 16 aa, Mus sp.
GPGAVEGPNPASSPDA

SEQ ID NO: 6038 - protein, 14 aa, Mus sp.
EVWERPLSNLAWAV

SEQ ID NO: 6039 - protein, 20 aa, Mus sp.
ESTEQLPNVQVEGPTPNRPR

SEQ ID NO: 6040 - protein, 15 aa, Mus sp.
DTRFVAPGALGNAPW

SEQ ID NO: 6041 - protein, 34 aa, Mus sp.; identical to SEQ ID NO: 1398

SEQ ID NO: 6042 - protein, 25 aa, Mus sp.
GPPIDIGRVTGPPIFNPVANEVYLN

SEQ ID NO: 6043 - protein, 18 aa, Mus sp.
TSQELVRAPTAALSPEPQ

SEQ ID NO: 6044 - protein, 14 aa, Mus sp.
IQWESSRPLLASIE

SEQ ID NO: 6045 - protein, 19 aa, Mus sp.
GFPKPPSYNVATTLPSYDE

SEQ ID NO: 6046 - protein, 16 aa, Mus sp.
IEFTFERSNTNPSVTV

SEQ ID NO: 6047 - protein, 18 aa, Mus sp.
NGNPLNSVFVAPAVTPVK

SEQ ID NO: 6048 - protein, 18 aa, Mus sp.
NPTLDHYKEPSAIFQLPY

SEQ ID NO: 6049 - protein, 14 aa, Mus sp.
EVGEYRQPSGGSVP

SEQ ID NO: 6050 - protein, 14 aa, Mus sp.
KFPDWSFPSAWVST

SEQ ID NO: 6051 - protein, 17 aa, Mus sp.
GENPIYKSAVTTVVNPK

SEQ ID NO: 6052 - protein, 26 aa, Mus sp.
GPSAPATPAAEAKAAEAAASAYYNPG

SEQ ID NO: 6053 - protein, 18 aa, Mus sp.
SLVLFCRVYRVWVLVVGG

SEQ ID NO: 6054 - protein, 17 aa, Mus sp.
SVPVTKTNLPNPSVDVK

SEQ ID NO: 6055 - protein, 18 aa, Mus sp.
DTIEFRGPNGLLVYQGKG

SEQ ID NO: 6056 - protein, 14 aa, Mus sp.
DVDFDFAGPAIHGS

SEQ ID NO: 6057 - protein, 16 aa, Mus sp.
IQPFHRAAAIQAISLD

SEQ ID NO: 6058 - protein, 15 aa, Mus sp.
KGFYKEATQLWGKAE

SEQ ID NO: 6059 - protein, 16 aa, Mus sp.
KPSTFAYPAPLEVPKE

SEQ ID NO: 6060 - protein, 16 aa, Mus sp.
AVDALASSHPLSSPAD

SEQ ID NO: 6061 - protein, 15 aa, Mus sp.
HTLFHNPHVNPLPTG

SEQ ID NO: 6062 - protein, 15 aa, Mus sp.
SSIYYISSTIAYAVG

SEQ ID NO: 6063 - protein, 16 aa, Mus sp.
DHVDFSQPEPHTVLFH

SEQ ID NO: 6064 - protein, 13 aa, Mus sp.
DNYRFAHTNIESL

SEQ ID NO: 6065 - protein, 16 aa, Mus sp.
YKRSNEFDYPSVGQLA

SEQ ID NO: 6066 - protein, 14 aa, Mus sp.
QEVLAPQVVLSLGG

SEQ ID NO: 6067 - protein, 12 aa, Mus sp.
KPFQNPVPNQSP

SEQ ID NO: 6068 - protein, 18 aa, Mus sp.
VNKGFYKEATQLWGKAEM

SEQ ID NO: 6069 - protein, 14 aa, Mus sp.
EVNSQYQEPDIIIH

SEQ ID NO: 6070 - protein, 13 aa, Mus sp.
AGNFYVPAEPKLA

SEQ ID NO: 6071 - protein, 18 aa, Mus sp.
TPAAPTSALGPKASPAPS

SEQ ID NO: 6072 - protein, 19 aa, Mus sp.
AAPAPAAAPAAAPAAAPEP

SEQ ID NO: 6073 - protein, 19 aa, Mus sp.
AGEFDYSGSQAIKALKEEN

SEQ ID NO: 6074 - protein, 12 aa, Mus sp.
LVYTSPVIPELK

SEQ ID NO: 6075 - protein, 18 aa, Mus sp.
WDLVDAVTPSPQPSKEED

SEQ ID NO: 6076 - protein, 16 aa, Mus sp.
LPAAAQAPDALPAGWE

SEQ ID NO: 6077 - protein, 20 aa, Mus sp.
NGKLTGMAFRVPTPNVSVVD

SEQ ID NO: 6078 - protein, 16 aa, Mus sp.
DDPIWRGPLPSNGVMH

SEQ ID NO: 6079 - protein, 17 aa, Mus sp.
SPTGNIFFSPFSISSAL

SEQ ID NO: 6080 - protein, 16 aa, Mus sp.
VLPANAFASPLQNPDN

SEQ ID NO: 6081 - protein, 17 aa, Mus sp.
LEMYKVHNPVPLIVGSS

SEQ ID NO: 6082 - protein, 16 aa, Mus sp.
FLKKWETPSQNTAQLD

SEQ ID NO: 6083 - protein, 18 aa, Mus sp.
DTPTDVTHHPIPSEEDIN

SEQ ID NO: 6084 - protein, 16 aa, Mus sp.
LDIYVWRGAQATLSNT

SEQ ID NO: 6085 - protein, 25 aa, Mus sp.
DAGTIAGLNVLRIINEPTAAAIAYG

SEQ ID NO: 6086 - protein, 13 aa, Mus sp.
YAVEKNPNAVVTL

SEQ ID NO: 6087 - protein, 14 aa, Mus sp.
TPYGAYNGPVPGYQ

SEQ ID NO: 6088 - protein, 14 aa, Mus sp.
EELVITPLPSGDVA

SEQ ID NO: 6089 - protein, 15 aa, Mus sp.
KPEDYQGGRTGEAIV

SEQ ID NO: 6090 - protein, 11 aa, Mus sp.
EDRRYNPPIIH

SEQ ID NO: 6091 - protein, 17 aa, Mus sp.
GRPDAEYWNSQPEILER

SEQ ID NO: 6092 - protein, 15 aa, Mus sp.
MPDMHFKAPKISMPD

SEQ ID NO: 6093 - protein, 16 aa, Mus sp.
VGPDYAHAEARKSPAL

SEQ ID NO: 6094 - protein, 14 aa, Mus sp.
SVPATFAPSPTPAV

SEQ ID NO: 6095 - protein, 14 aa, Mus sp.
YNEVHSPSVAVEMG

SEQ ID NO: 6096 - protein, 13 aa, Mus sp.
FPIKWTAPEAINF

SEQ ID NO: 6097 - protein, 15 aa, Mus sp.
ISKQEYDESGPSIVH

SEQ ID NO: 6098 - protein, 15 aa, Mus sp.
GIFQYQQALANMQLQ

SEQ ID NO: 6099 - protein, 23 aa, Mus sp.
EIDLKGIPVYRFVLPANAFASPL

SEQ ID NO: 6100 - protein, 16 aa, Mus sp.
SMPDYKPSFPKWARQD

SEQ ID NO: 6101 - protein, 14 aa, Mus sp.
YAVDIRSPAISWVN

SEQ ID NO: 6102 - protein, 15 aa, Mus sp.
IEHLYKNPQAHIEGN

SEQ ID NO: 6103 - protein, 16 aa, Mus sp.
APTPAATPAASPAPVS

SEQ ID NO: 6104 - protein, 14 aa, Mus sp.
GAPFDWEGAQASQA

SEQ ID NO: 6105 - protein, 17 aa, Mus sp.
ESKEAFQEALAAAGDKL

SEQ ID NO: 6106 - protein, 15 aa, Mus sp.
GDPFAAPQVVPAFAS

SEQ ID NO: 6107 - protein, 27 aa, Mus sp.
YVDPTPDPNTAYASYPSASVENYQQPP

SEQ ID NO: 6108 - protein, 17 aa, Mus sp.
VGPVPWLGPQTDEAIKG

SEQ ID NO: 6109 - protein, 17 aa, Mus sp.
KPGSDTIKPDVNKSKEY

SEQ ID NO: 6110 - protein, 17 aa, Listeria monocytogenes
YPGSDETPPVVNPGETN

SEQ ID NO: 6111 - protein, 16 aa, Mus sp.
LDKDSFSDPYAHVSFL

SEQ ID NO: 6112 - protein, 17 aa, Mus sp.
APSNTFVAPQPVVASPA

SEQ ID NO: 6113 - protein, 24 aa, Mus sp.
YVDPTPDPNTAYASYPSASVENYQ

SEQ ID NO: 6114 - protein, 17 aa, Mus sp.
GHPGIIPPHATLVFDVE

SEQ ID NO: 6115 - protein, 17 aa, Mus sp.
LPEAPSAESPSPSESPP

SEQ ID NO: 6116 - protein, 15 aa, Mus sp.
AMLQVLGPKPALPEG

SEQ ID NO: 6117 - protein, 17 aa, Mus sp.
LSRWEQEQIRKGINIPQ

SEQ ID NO: 6118 - protein, 17 aa, Mus sp.
QPGLNGAAAAAAAEAPD

SEQ ID NO: 6119 - protein, 17 aa, Mus sp.
NRPAFMPSEGRMVSDIN

SEQ ID NO: 6120 - protein, 15 aa, Mus sp.
DLDIFNLPNVEISKD

SEQ ID NO: 6121 - protein, 19 aa, Mus sp.
DSVTTDHISPAGNIARNSP

SEQ ID NO: 6122 - protein, 14 aa, Mus sp.
VDEYDYSKPIQGQQ

SEQ ID NO: 6123 - protein, 16 aa, Mus sp.
GALAASAPVVAVAGLG

SEQ ID NO: 6124 - protein, 13 aa, Mus sp.
DAFVLKTPSAAYL

SEQ ID NO: 6125 - protein, 16 aa, Mus sp.
MAFRVPTPNVSVVDLT

SEQ ID NO: 6126 - protein, 15 aa, Mus sp.
EDYVQSMDVAAFNKI

SEQ ID NO: 6127 - protein, 18 aa, Mus sp.
VPYVEKYRPASASVSALI

SEQ ID NO: 6128 - protein, 15 aa, Mus sp.
LKDREQHMFKISALE

SEQ ID NO: 6129 - protein, 16 aa, Mus sp.
APGGYVAPKAVWLPAV

SEQ ID NO: 6130 - protein, 15 aa, Mus sp.
FPDNYNSPTPYKIQY

SEQ ID NO: 6131 - protein, 14 aa, Mus sp.
GVDFIGSTVGLAKV

SEQ ID NO: 6132 - protein, 15 aa, Mus sp.
AEVEFSAPYPMEVIF

SEQ ID NO: 6133 - protein, 17 aa, Mus sp.
EIKVYWDAPSPAPDHIR

SEQ ID NO: 6134 - protein, 20 aa, Mus sp.
SSSIASFKDPKISTSLPVLD

SEQ ID NO: 6135 - protein, 15 aa, Mus sp.
VTEYTPRSWNFLHTL

SEQ ID NO: 6136 - protein, 15 aa, Mus sp.
GAPFDWEGAQASQAL

SEQ ID NO: 6137 - protein, 15 aa, Mus sp.
LVFDVTAPNTFKTLD

SEQ ID NO: 6138 - protein, 18 aa, Mus sp.
AGPQWADPQISESNFSPK

SEQ ID NO: 6139 - protein, 18 aa, Mus sp.
LQSTDYGNFLANEASPLT

SEQ ID NO: 6140 - protein, 16 aa, Mus sp.
DINAFVGAVSLTAADS

SEQ ID NO: 6141 - protein, 17 aa, Mus sp.
VPPPFAAAAINEAIDAE

SEQ ID NO: 6142 - protein, 16 aa, BOVIN
AVPDAAGPTPSAAGPP

SEQ ID NO: 6143 - protein, 15 aa, Mus sp.
VDPFKAVDTNRASMG

SEQ ID NO: 6144 - protein, 15 aa, Mus sp.
LPDVYDWPESSLTPP

SEQ ID NO: 6145 - protein, 14 aa, Mus sp.
VGDIFSNPEAVLAK

SEQ ID NO: 6146 - protein, 13 aa, Mus sp.
DGYQMAQPVFAPK

SEQ ID NO: 6147 - protein, 16 aa, Mus sp.
VYTRYHCSLPVPEPSA

SEQ ID NO: 6148 - protein, 11 aa, Mus sp.
AEYWNSQPEIL

SEQ ID NO: 6149 - protein, 15 aa, Mus sp.
SLVSWVGSEPMPEAG

SEQ ID NO: 6150 - protein, 15 aa, Mus sp.
VLIPYQGPSSDYVVV

SEQ ID NO: 6151 - protein, 14 aa, Mus sp.
GYKPFQNPVPNQSP

SEQ ID NO: 6152 - protein, 18 aa, Mus sp.
NPWGEVEWKGPWSDSSYE

SEQ ID NO: 6153 - protein, 16 aa, Mus sp.
FVEEFIWPAVQSSALY

SEQ ID NO: 6154 - protein, 16 aa, Mus sp.
GTPDYISPEVLKSQGG

SEQ ID NO: 6155 - protein, 16 aa, Mus sp.
TEDDYNEPTVHFAEDT

SEQ ID NO: 6156 - protein, 19 aa, Mus sp.
APAAAATTAAPAAAAAPAK

SEQ ID NO: 6157 - protein, 19 aa, Mus sp.
DPAGPNFEYAEAPSRLSPD

SEQ ID NO: 6158 - protein, 16 aa, Mus sp.
VPVPGSPFPLEAVAPT

SEQ ID NO: 6159 - protein, 13 aa, Mus sp.
KLPFAAAQIGNSF

SEQ ID NO: 6160 - protein, 24 aa, Mus sp.
EAQKSSSIASFKDPKISTSLPVLD

SEQ ID NO: 6161 - protein, 16 aa, Mus sp.
SPVDFHTPSSPKSPPS

SEQ ID NO: 6162 - protein, 21 aa, Mus sp.
GKLTGMAFRVPTPNVSVVDLT

SEQ ID NO: 6163 - protein, 15 aa, Mus sp.
TALTFSSPATNQAIT

SEQ ID NO: 6164 - protein, 17 aa, Mus sp.
DGDSVVFAGPAGNSVET

SEQ ID NO: 6165 - protein, 21 aa, Mus sp.
DDGHGGYKPFQNPVPNQSPSS

SEQ ID NO: 6166 - protein, 17 aa, Mus sp.
DPTNPFRFPNIGVEKFL

SEQ ID NO: 6167 - protein, 17 aa, Mus sp.
DPAEYDVSPETRRAQVE

SEQ ID NO: 6168 - protein, 15 aa, Mus sp.
IFYGASIASLSASHS

SEQ ID NO: 6169 - protein, 16 aa, Mus sp.
LPNSFDGPVTITIVNR

SEQ ID NO: 6170 - protein, 17 aa, Mus sp.
KPGTTVEYLAPWANQID

SEQ ID NO: 6171 - protein, 13 aa, Mus sp.
EVLAPQVVLSLGG

SEQ ID NO: 6172 - protein, 18 aa, Mus sp.
ESKATYSTNSPVWEEAFR

SEQ ID NO: 6173 - protein, 16 aa, Mus sp.
TPEYLAPEIILSKGYN

SEQ ID NO: 6174 - protein, 21 aa, Mus sp.
GPPRLDLLDLAPEPRYAHIPV

SEQ ID NO: 6175 - protein, 16 aa, Mus sp.
DGELTYENVQVSPVPG

SEQ ID NO: 6176 - protein, 16 aa, Mus sp.
TPAPTPAATPAASPAP

SEQ ID NO: 6177 - protein, 15 aa, Mus sp.
EEWGPFKAPHANRFI

SEQ ID NO: 6178 - protein, 15 aa, Mus sp.
TPSYYTTSDAVISTE

SEQ ID NO: 6179 - protein, 13 aa, Mus sp.
GVELYRAPFPLYA

SEQ ID NO: 6180 - protein, 15 aa, Mus sp.
SSPYNPPDLEEAAKT

SEQ ID NO: 6181 - protein, 15 aa, Mus sp.
VAVNWYAPLVAPISK

SEQ ID NO: 6182 - protein, 17 aa, Mus sp.
EPKESVLPPKTSAAAQL

SEQ ID NO: 6183 - protein, 15 aa, Mus sp.
GTPYWMSPEVISGEG

SEQ ID NO: 6184 - protein, 13 aa, Mus sp.
ITDKFWGPSGAES

SEQ ID NO: 6185 - protein, 18 aa, Mus sp.
DPDGFSWPATLPSVYKQP

SEQ ID NO: 6186 - protein, 16 aa, Mus sp.
VLFVYGGPQVQLVNNS

SEQ ID NO: 6187 - protein, 15 aa, Mus sp.
LDNYDAPDIANIAIS

SEQ ID NO: 6188 - protein, 16 aa, Mus sp.
LTPWLAPIVSEGTFDP

SEQ ID NO: 6189 - protein, 15 aa, Mus sp.
TIQWWNMPSPNVDPY

SEQ ID NO: 6190 - protein, 14 aa, Mus sp.
NSVFVAPAVTPVKG

SEQ ID NO: 6191 - protein, 16 aa, Mus sp.
APMYYRGSAAAVIVYD

SEQ ID NO: 6192 - protein, 20 aa, Mus sp.
SDDVLANMISEPRISYGNDA

SEQ ID NO: 6193 - protein, 19 aa, Mus sp.
DLYTAKGLFRAAVPSGAST

SEQ ID NO: 6194 - protein, 23 aa, Mus sp.
KPSEGEEEAASAGGPQVNPMPVT

SEQ ID NO: 6195 - protein, 15 aa, Mus sp.
YHFVTPLTSMVVTKP

SEQ ID NO: 6196 - protein, 15 aa, Mus sp.
SCKYSHLITSHQFQP

SEQ ID NO: 6197 - protein, 16 aa, Mus sp.
IRSDWTNPEINKAVLH

SEQ ID NO: 6198 - protein, 14 aa, Mus sp.
KKFRFEEPVVLPDL

SEQ ID NO: 6199 - protein, 15 aa, Mus sp.
EQFVYSSPHDNKSWE

SEQ ID NO: 6200 - protein, 22 aa, Mus sp.
KHVPSGIVVKVETGGEPRSAAT

SEQ ID NO: 6201 - protein, 20 aa, Mus sp.
GNPLNSVFVAPAVTPVKGVL

SEQ ID NO: 6202 - protein, 21 aa, Mus sp.
EEKPVPAAPVPSPVAPAPVPS

SEQ ID NO: 6203 - protein, 20 aa, Mus sp.
DSVTTDHISPAGNIARNSPA

SEQ ID NO: 6204 - protein, 15 aa, Mus sp.
SVGAWTGPMGNWAMF

SEQ ID NO: 6205 - protein, 18 aa, Mus sp.
DERFGVRFPAMSDAYDRD

SEQ ID NO: 6206 - protein, 15 aa, Mus sp.
GPGSAVSPYPSFNVS

SEQ ID NO: 6207 - protein, 14 aa, Mus sp.
FDQGYEAPGVREAA

SEQ ID NO: 6208 - protein, 18 aa, Mus sp.
MPDMHFKAPKISMPDVDL

SEQ ID NO: 6209 - protein, 16 aa, Mus sp.
ESKEAFQEALAAAGDK

SEQ ID NO: 6210 - protein, 13 aa, Mus sp.
VQIYHNPTANSFR

SEQ ID NO: 6211 - protein, 15 aa, Mus sp.
DIDSFVPSKAAPAAA

SEQ ID NO: 6212 - protein, 17 aa, Mus sp.
SPSSPEYTPASPKYSPT

SEQ ID NO: 6213 - protein, 16 aa, Mus sp.
IKVYWDAPSPAPDHIR

SEQ ID NO: 6214 - protein, 18 aa, Mus sp.
GIDPYDQPNAIYIERHEP

SEQ ID NO: 6215 - protein, 17 aa, Mus sp.
SHPQYAEPGAEAAFSGR

SEQ ID NO: 6216 - protein, 16 aa, Mus sp.
VGGERFEAPEALFQPH

SEQ ID NO: 6217 - protein, 15 aa, Mus sp.
SIVYWMTSQPSDAVR

SEQ ID NO: 6218 - protein, 19 aa, Mus sp.
ADWQGGVYASPSIAGSRPG

SEQ ID NO: 6219 - protein, 10 aa, Mus sp.
TPDYIAPEII

SEQ ID NO: 6220 - protein, 16 aa, Mus sp.
SPPPYAAYATPTPEVY

SEQ ID NO: 6221 - protein, 13 aa, Mus sp.
TGMAFRVPTPNVS

SEQ ID NO: 6222 - protein, 14 aa, Mus sp.
EAGQSKGFGLICFF

SEQ ID NO: 6223 - protein, 15 aa, Mus sp.
NPDFTQPISEVVDEV

SEQ ID NO: 6224 - protein, 13 aa, Mus sp.
GYVPSQADVAVFE

SEQ ID NO: 6225 - protein, 18 aa, Listeria monocytogenes
GLLMAKKYKMNLTIVIVN

SEQ ID NO: 6226 - protein, 16 aa, Mus sp.
LSLDWHPNNVLLAAGS

SEQ ID NO: 6227 - protein, 14 aa, Mus sp.
DTEVYESPYADPEE

SEQ ID NO: 6228 - protein, 16 aa, Mus sp.
LSLLYKVPYVAQEIQE

SEQ ID NO: 6229 - protein, 16 aa, Mus sp.
VKARVANPSGNLTDTY

SEQ ID NO: 6230 - protein, 22 aa, Mus sp.
NDQGNRITPSYVAFTPEGERLI

SEQ ID NO: 6231 - protein, 15 aa, Mus sp.
VEALEQPAPAIVSAL

SEQ ID NO: 6232 - protein, 18 aa, Mus sp.
RPDAEYWNSQPEILERTR

SEQ ID NO: 6233 - protein, 16 aa, Mus sp.
NPTDEYLDAMMNEAPG

SEQ ID NO: 6234 - protein, 11 aa, Mus sp.
VFVAPAVTPVK

SEQ ID NO: 6235 - protein, 18 aa, Mus sp.
AGDAVAVAPAPAAAVEPA

SEQ ID NO: 6236 - protein, 17 aa, Mus sp.
EVNSQYQEPDIIIHFAR

SEQ ID NO: 6237 - protein, 24 aa, Mus sp.
TPARAPETRSQVTPSVPSEALDDS

SEQ ID NO: 6238 - protein, 16 aa, Mus sp.
YLPETFRRPQIDPAVE

SEQ ID NO: 6239 - protein, 13 aa, Mus sp.
DAEYWNSQPEILE

SEQ ID NO: 6240 - protein, 14 aa, Mus sp.
DTVTISGPQAAVNE

SEQ ID NO: 6241 - protein, 17 aa, Mus sp.
DVVDRVLKSPVASIVYE

SEQ ID NO: 6242 - protein, 14 aa, Mus sp.
IEFRGPNGLLVYQG

SEQ ID NO: 6243 - protein, 11 aa, Mus sp.
SVFVAPAVTPV

SEQ ID NO: 6244 - protein, 18 aa, Mus sp.
APAAAATTAAPAAAAAPA

SEQ ID NO: 6245 - protein, 16 aa, Mus sp.
SNPSYNYEIVNRASLA

SEQ ID NO: 6246 - protein, 17 aa, Mus sp.
GPRAEEYEFLTPMEEAP

SEQ ID NO: 6247 - protein, 23 aa, Mus sp.
VPPAGGGDPEAPAPAPAAERPPA

SEQ ID NO: 6248 - protein, 19 aa, Mus sp.
LPQEKYVTSAPMPEPGAPG

SEQ ID NO: 6249 - protein, 20 aa, Mus sp.
KLTGMAFRVPTPNVSVVDLT

SEQ ID NO: 6250 - protein, 15 aa, Mus sp.
GELTYENVQVSPVPG

SEQ ID NO: 6251 - protein, 19 aa, Mus sp.
DPAVADLVKNPTASLVLPE

SEQ ID NO: 6252 - protein, 15 aa, Mus sp.
EDVIAEPEGTHSFDG

SEQ ID NO: 6253 - protein, 14 aa, Mus sp.
EALVGPEANVGPYG

SEQ ID NO: 6254 - protein, 14 aa, Mus sp.
FGPYYTEPVIAGLD

SEQ ID NO: 6255 - protein, 13 aa, Mus sp.
NIYWTDSVPGSVS

SEQ ID NO: 6256 - protein, 17 aa, Mus sp.
VEYHFLSPYVSPRESPF

SEQ ID NO: 6257 - protein, 16 aa, Mus sp.
TPTFTYKAAHIFFTDT

SEQ ID NO: 6258 - protein, 14 aa, Mus sp.
FEVQWQSAEPGSTP

SEQ ID NO: 6259 - protein, 16 aa, Mus sp.
AIVDPYNNPVPRGLEA

SEQ ID NO: 6260 - protein, 21 aa, Mus sp.
GQDHVDFSQPEPHTVLFHEPG

SEQ ID NO: 6261 - protein, 12 aa, Mus sp.
DPYDQPNAIYIE

SEQ ID NO: 6262 - protein, 16 aa, Mus sp.
LPYVQYFGGVSALSKQ

SEQ ID NO: 6263 - protein, 17 aa, Mus sp.
NPLNSVFVAPAVTPVKG

SEQ ID NO: 6264 - protein, 17 aa, Mus sp.
LVKDGYQMAQPVFAPKN

SEQ ID NO: 6265 - protein, 16 aa, Mus sp.
IPSGLFIPSMAVGAIA

SEQ ID NO: 6266 - protein, 19 aa, Mus sp.
KPADITDVVKPIALPTEEP

SEQ ID NO: 6267 - protein, 24 aa, Mus sp.
IPELNGKLTGMAFRVPTPNVSVVD

SEQ ID NO: 6268 - protein, 16 aa, Mus sp.
VGPVPWLGPQTDEAIK

SEQ ID NO: 6269 - protein, 18 aa, Mus sp.
EKPVPAAPVPSPVAPAPV

SEQ ID NO: 6270 - protein, 15 aa, Mus sp.
DLLYSFPVVIKNKTW

SEQ ID NO: 6271 - protein, 18 aa, Mus sp.
ITIGNERFRCPEAIFQPS

SEQ ID NO: 6272 - protein, 13 aa, Mus sp.
APYQGPDAAPGAL

SEQ ID NO: 6273 - protein, 16 aa, Mus sp.
DPDFLRTAVAQVIGDR

SEQ ID NO: 6274 - protein, 17 aa, Mus sp.
TVPFWAHAGNAIPSADQ

SEQ ID NO: 6275 - protein, 14 aa, Mus sp.
NLDWQYPGSRGSPP

SEQ ID NO: 6276 - protein, 16 aa, Mus sp.
LVFDVTAPNTFKTLDS

SEQ ID NO: 6277 - protein, 14 aa, Mus sp.
FETFNTPAMYVAIQ

SEQ ID NO: 6278 - protein, 16 aa, Mus sp.
GTPGYVAPEVLAQKPY

SEQ ID NO: 6279 - protein, 17 aa, Mus sp.
LPETFRRPQIDPAVEGF

SEQ ID NO: 6280 - protein, 11 aa, Mus sp.
HDLDFRAPHVL

SEQ ID NO: 6281 - protein, 15 aa, Mus sp.
SMRYFETAVSRPGLE

SEQ ID NO: 6282 - protein, 16 aa, Mus sp.
DWLRYSPAYAHLVAPG

SEQ ID NO: 6283 - protein, 16 aa, Mus sp.
KPSQAGWFDQIAVKVA

SEQ ID NO: 6284 - protein, 15 aa, Mus sp.
EVEFSAPYPMEVIFE

SEQ ID NO: 6285 - protein, 16 aa, Mus sp.
GLELEEPPLVLAAANV

SEQ ID NO: 6286 - protein, 17 aa, Mus sp.
DTNLNDLGPRALEIYRA

SEQ ID NO: 6287 - protein, 16 aa, Mus sp.
EVAFNGPKGGYVALDD

SEQ ID NO: 6288 - protein, 16 aa, Mus sp.
GIFTFEEPVTHVSESI

SEQ ID NO: 6289 - protein, 14 aa, Mus sp.
DSKIVVPPLPGKAL

SEQ ID NO: 6290 - protein, 17 aa, Mus sp.
EATRYLAPTILTDVDPN

SEQ ID NO: 6291 - protein, 15 aa, Mus sp.
EDRRYNPPIIHQGFQ

SEQ ID NO: 6292 - protein, 21 aa, Mus sp.
AFLGGGAPGSRHPGGGDYEEL

SEQ ID NO: 6293 - protein, 13 aa, Mus sp.
ALVYTSPVIPELK

SEQ ID NO: 6294 - protein, 16 aa, Mus sp.
SAFSYVDPVITSISPR

SEQ ID NO: 6295 - protein, 20 aa, Mus sp.
SPTSPSYSPTSPNYSPTSPS

SEQ ID NO: 6296 - protein, 20 aa, Mus sp.
RPPGPPPAPQPPSPAPSPPP

SEQ ID NO: 6297 - protein, 16 aa, Mus sp.
GNLDYWTYPGSLTTPP

SEQ ID NO: 6298 - protein, 16 aa, Mus sp.
HTSYYSESVVRESYIG

SEQ ID NO: 6299 - protein, 17 aa, Mus sp.
DEDIILKAPIAAPEPEL

SEQ ID NO: 6300 - protein, 16 aa, Mus sp.
DDDFEPYLSPQARPNN

SEQ ID NO: 6301 - protein, 13 aa, Mus sp.
HDLDFRAPHVLVL

SEQ ID NO: 6302 - protein, 15 aa, Mus sp.
DVNTYNAAIAYTIVS

SEQ ID NO: 6303 - protein, 15 aa, Mus sp.
LPTYDASKVTASGPG

SEQ ID NO: 6304 - protein, 17 aa, Mus sp.
NPDEAVAYGAAVQAAIL

SEQ ID NO: 6305 - protein, 16 aa, Mus sp.
KPSPIYISSYSSPARE

SEQ ID NO: 6306 - protein, 12 aa, Mus sp.
GAWTGPMGNWAM

SEQ ID NO: 6307 - protein, 23 aa, Mus sp.
LDPAGPNFEYAEAPSRLSPDDAD

SEQ ID NO: 6308 - protein, 14 aa, BOVIN
VVVGPSVVAVPLPL

SEQ ID NO: 6309 - protein, 16 aa, Mus sp.
TGVDFIGSTVGLAKVS

SEQ ID NO: 6310 - protein, 16 aa, Mus sp.
TPVFVHAGPFANIAHG

SEQ ID NO: 6311 - protein, 16 aa, Mus sp.
MSTHFWGPVANWGLPI

SEQ ID NO: 6312 - protein, 15 aa, Mus sp.
VMDAYTSAVSLSATG

SEQ ID NO: 6313 - protein, 14 aa, Mus sp.
IEGYVPSQADVAVF

SEQ ID NO: 6314 - protein, 16 aa, Mus sp.
FNLDAEAPAVLSGPPG

SEQ ID NO: 6315 - protein, 13 aa, Mus sp.
IPYQGPSSDYVVV

SEQ ID NO: 6316 - protein, 16 aa, Mus sp.
KVEPYEVHNPVPLIVG

SEQ ID NO: 6317 - protein, 18 aa, Mus sp.
IARQNFTEPTAIQAQGWP

SEQ ID NO: 6318 - protein, 15 aa, Mus sp.
ELPDIAPPLVTPDEP

SEQ ID NO: 6319 - protein, 21 aa, Mus sp.
LPEGDISISGPKVNVEAPNVN

SEQ ID NO: 6320 - protein, 17 aa, Mus sp.
APLDELVGAYPNYNEEE

SEQ ID NO: 6321 - protein, 19 aa, Mus sp.
DPEDHTVSFVQPNGAIFEP

SEQ ID NO: 6322 - protein, 14 aa, Mus sp.
APYQGPDAAPGALD

SEQ ID NO: 6323 - protein, 11 aa, Mus sp.
SDWTNPEINKA

SEQ ID NO: 6324 - protein, 14 aa, Mus sp.
WKFTITPPSAQVVG

SEQ ID NO: 6325 - protein, 16 aa, Mus sp.
GFLSEIGSQALAAGSY

SEQ ID NO: 6326 - protein, 16 aa, Mus sp.
DSPDVVYSPETIEARY

SEQ ID NO: 6327 - protein, 16 aa, Mus sp.
GVPTVPLLPPQVNQSL

SEQ ID NO: 6328 - protein, 18 aa, Mus sp.
VPVPEFADSDPANIVHDF

SEQ ID NO: 6329 - protein, 22 aa, Mus sp.
DESGFPKPPSYNVATTLPSYDE

SEQ ID NO: 6330 - protein, 12 aa, Mus sp.
EFIWPAVQSSAL

SEQ ID NO: 6331 - protein, 16 aa, Mus sp.
AEQEVLAPQVVLSLGG

SEQ ID NO: 6332 - protein, 17 aa, Mus sp.
GDTIEFRGPNGLLVYQG

SEQ ID NO: 6333 - protein, 17 aa, Mus sp.
ASAYYNPGNPHNVYMPT

SEQ ID NO: 6334 - protein, 17 aa, Mus sp.
SEERVYMVGKANSVFED

SEQ ID NO: 6335 - protein, 21 aa, Mus sp.
NPEPPPPRSHYSNIEANESEE

SEQ ID NO: 6336 - protein, 17 aa, Mus sp.
DYVELPPSVSQAAKSPP

SEQ ID NO: 6337 - protein, 13 aa, Mus sp.
GSPNYAAPEVISG

SEQ ID NO: 6338 - protein, 23 aa, Mus sp.
PGPNIGGDTHFDSAEPWTVQNED

SEQ ID NO: 6339 - protein, 18 aa, Mus sp.
APAPAPAAAPAPAPAAQA

SEQ ID NO: 6340 - protein, 16 aa, Mus sp.
ATLEIKGPQADLIDAV

SEQ ID NO: 6341 - protein, 19 aa, Mus sp.
DPAKGRIYQGTEADSIFSG

SEQ ID NO: 6342 - protein, 17 aa, Mus sp.
DDDVNTYNAAIAYTIVS

SEQ ID NO: 6343 - protein, 16 aa, Mus sp.
SVGAWTGPMGNWAMFT

SEQ ID NO: 6344 - protein, 15 aa, Mus sp.
LLLHWQPPLSHNGVL

SEQ ID NO: 6345 - protein, 16 aa, Mus sp.
ENLYPYLGPSTLRDRP

SEQ ID NO: 6346 - protein, 26 aa, Mus sp.
VIPELNGKLTGMAFRVPTPNVSVVDL

SEQ ID NO: 6347 - protein, 16 aa, Mus sp.
DDLQPWHPFGVDSVPA

SEQ ID NO: 6348 - protein, 15 aa, Mus sp.
YFETAVSRPGLEEPR

SEQ ID NO: 6349 - protein, 16 aa, Mus sp.
SLKYHFVTPLTSMVVT

SEQ ID NO: 6350 - protein, 16 aa, Mus sp.
LPHFLHASPDVSEPIE

SEQ ID NO: 6351 - protein, 17 aa, Mus sp.
ETDSVVSSVTTKAKGVA

SEQ ID NO: 6352 - protein, 18 aa, Mus sp.
TEQTYWQATPFRAVAEPG

SEQ ID NO: 6353 - protein, 14 aa, Mus sp.
FPDNYNSPTPYKIQ

SEQ ID NO: 6354 - protein, 17 aa, Mus sp.
SPHPYQLPQALAPHVDF

SEQ ID NO: 6355 - protein, 16 aa, Mus sp.
LPSTSYLPSTPSVVPA

SEQ ID NO: 6356 - protein, 15 aa, Mus sp.
FYLALPPTVYEAVTK

SEQ ID NO: 6357 - protein, 18 aa, Mus sp.
DGVPVPGSPFPLEAVAPT

SEQ ID NO: 6358 - protein, 13 aa, Mus sp.
VQPYSGSPANLAA

SEQ ID NO: 6359 - protein, 18 aa, Mus sp.
DPTAGHSNAPIAAPAEVE

SEQ ID NO: 6360 - protein, 23 aa, Mus sp.
PPGFEDYVELPPSVSQAATSPPG

SEQ ID NO: 6361 - protein, 16 aa, Mus sp.
IGGDPFAAPQVVPAFA

SEQ ID NO: 6362 - protein, 15 aa, Mus sp.
VGDLYTDPQIHTEKG

SEQ ID NO: 6363 - protein, 14 aa, Mus sp.
IEVWERPLSNLAWA

SEQ ID NO: 6364 - protein, 14 aa, Mus sp.
EVYHEPHIADAWPQ

SEQ ID NO: 6365 - protein, 12 aa, Mus sp.
DLQYAAPGGLIG

SEQ ID NO: 6366 - protein, 20 aa, Mus sp.
YPNPTLDHYKEPSAIFQLPY

SEQ ID NO: 6367 - protein, 17 aa, Mus sp.
LLGNMWAQTWSNIYDLV

SEQ ID NO: 6368 - protein, 15 aa, Mus sp.
NNIPYFETSAKEAIN

SEQ ID NO: 6369 - protein, 15 aa, Mus sp.
VSSYTPPQPSYSQPP

SEQ ID NO: 6370 - protein, 18 aa, Mus sp.
IHKSFVEVNEEGTEAAAA

SEQ ID NO: 6371 - protein, 14 aa, Mus sp.
FFWNVAPGAESAVA

SEQ ID NO: 6372 - protein, 16 aa, Mus sp.
RRTDWEAPTGQPSAPG

SEQ ID NO: 6373 - protein, 15 aa, Mus sp.
TTTWQRPTAEYVRNY

SEQ ID NO: 6374 - protein, 22 aa, Mus sp.
GSKVDFVAWATGEPNFANDDEN

SEQ ID NO: 6375 - protein, 19 aa, Mus sp.
KPGTTVEYLAPWANQIDMA

SEQ ID NO: 6376 - protein, 17 aa, Mus sp.
KSFVQNYPVVSIEDPFD

SEQ ID NO: 6377 - protein, 17 aa, Mus sp.
QPPEYTFPSGSGAHFPQ

SEQ ID NO: 6378 - protein, 16 aa, Mus sp.
NNQAYHSPATALAIVD

SEQ ID NO: 6379 - protein, 16 aa, Mus sp.
SYPFDFQGAKIITGQE

SEQ ID NO: 6380 - protein, 9 aa, Mus sp.
YIAPEILQG

SEQ ID NO: 6381 - protein, 16 aa, Mus sp.
SNLLLQSPGVLTAARE

SEQ ID NO: 6382 - protein, 16 aa, Mus sp.
QSTDYGNFLANEASPL

SEQ ID NO: 6383 - protein, 14 aa, Mus sp.
SPHPYQLPQALAPH

SEQ ID NO: 6384 - protein, 16 aa, Mus sp.
KADDIVGPVTHEIFEN

SEQ ID NO: 6385 - protein, 12 aa, Mus sp.
TDYNSPEAGNIF

SEQ ID NO: 6386 - protein, 15 aa, Mus sp.
DIRSDWTNPEINKAV

SEQ ID NO: 6387 - protein, 18 aa, Mus sp.
MLDENNHLIQCIMDYQNK

SEQ ID NO: 6388 - protein, 20 aa, Mus sp.
SPTSPSYSPTSPNYSPTSPN

SEQ ID NO: 6389 - protein, 20 aa, Mus sp.
KNPTDAYLDAMMNEAPGPIN

SEQ ID NO: 6390 - protein, 24 aa, Mus sp.
LPNKPTVTVVSPLPNDSINPQPSP

SEQ ID NO: 6391 - protein, 19 aa, Mus sp.
DDGTVIHFNNPKVQASLSA

SEQ ID NO: 6392 - protein, 13 aa, Mus sp.
YLVYQEPIPTAQL

SEQ ID NO: 6393 - protein, 16 aa, Mus sp.
SGVEWKGPQVSSSLNL

SEQ ID NO: 6394 - protein, 14 aa, Mus sp.
DQKFYNFVVIHARA

SEQ ID NO: 6395 - protein, 18 aa, Mus sp.
DYVELPPSVSQAATSPPG

SEQ ID NO: 6396 - protein, 22 aa, Mus sp.
VPPGLEFLVQIDQILIHQKAER

SEQ ID NO: 6397 - protein, 13 aa, Mus sp.
GIPVYRFVLPANA

SEQ ID NO: 6398 - protein, 17 aa, Mus sp.
NLRDNYRFAHTNIESLV

SEQ ID NO: 6399 - protein, 24 aa, Mus sp.
GPDGKGMNPPSYYTQPVPVPNANA

SEQ ID NO: 6400 - protein, 16 aa, Mus sp.
APASAEAPAPNQAPAP

SEQ ID NO: 6401 - protein, 16 aa, Mus sp.
EQEVLAPQVVLSLGGS

SEQ ID NO: 6402 - protein, 15 aa, Mus sp.
YPTAYPAAAPAYNPS

SEQ ID NO: 6403 - protein, 19 aa, Mus sp.
DTGENPIYKSAVTTVVNPK

SEQ ID NO: 6404 - protein, 23 aa, Mus sp.
LMEKIQASVATNPIITPVAQENQ

SEQ ID NO: 6405 - protein, 15 aa, Mus sp.
GTPEFLAPEVLTDTS

SEQ ID NO: 6406 - protein, 24 aa, Mus sp.
GPGEPSPVSETVVTPEAAPEKNPV

SEQ ID NO: 6407 - protein, 18 aa, Listeria monocytogenes
GGINQAYTGSTALSDGLN

SEQ ID NO: 6408 - protein, 16 aa, Mus sp.
DSNFGAPSASVAAAPA

SEQ ID NO: 6409 - protein, 16 aa, Mus sp.
GEQKLFISPGLLPEAP

SEQ ID NO: 6410 - protein, 13 aa, Mus sp.
LAWNAPAVLQKPY

SEQ ID NO: 6411 - protein, 18 aa, Mus sp.
DLGSDIFAAPAPQSTATA

SEQ ID NO: 6412 - protein, 17 aa, Mus sp.
LPPHVYSTPQPSLPPVQ

SEQ ID NO: 6413 - protein, 15 aa, Mus sp.
APVPSPVAPAPVPSR

SEQ ID NO: 6414 - protein, 13 aa, Mus sp.
FPQYTAPSILPSD

SEQ ID NO: 6415 - protein, 16 aa, Mus sp.
LQSTDYGNFLANEASP

SEQ ID NO: 6416 - protein, 12 aa, Mus sp.
INYQPPTVVPGG

SEQ ID NO: 6417 - protein, 15 aa, Mus sp.
LEVVTDPTTNAGYVK

SEQ ID NO: 6418 - protein, 17 aa, Mus sp.
DVDFDFAGPAIHGSAVF

SEQ ID NO: 6419 - protein, 15 aa, Mus sp.
FGNSEFDPPGPNVAT

SEQ ID NO: 6420 - protein, 14 aa, Mus sp.
GPKPFSAPKPQTSP

SEQ ID NO: 6421 - protein, 17 aa, Mus sp.
IDWTYRPPSSSRTESIF

SEQ ID NO: 6422 - protein, 12 aa, Mus sp.
TPEYLAPEIILS

SEQ ID NO: 6423 - protein, 13 aa, Mus sp.
LDNYDAPDIANIA

SEQ ID NO: 6424 - protein, 16 aa, Mus sp.
FPGQPGAPGAYPSAPG

SEQ ID NO: 6425 - protein, 21 aa, Mus sp.
DPGESKSYSYSEVLPTEGPPS

SEQ ID NO: 6426 - protein, 16 aa, Mus sp.
EFSFWNEPVPRPGPNI

SEQ ID NO: 6427 - protein, 16 aa, Mus sp.
EGERYIAPTVLVDVQE

SEQ ID NO: 6428 - protein, 15 aa, Mus sp.
MAFRVPTPNVSVVDL

SEQ ID NO: 6429 - protein, 17 aa, Mus sp.
TPTDVTHHPIPSEEDIN

SEQ ID NO: 6430 - protein, 17 aa, Mus sp.
WKALYTDPKSSETAAFV

SEQ ID NO: 6431 - protein, 15 aa, Mus sp.
SSEVYTFPVPERHLE

SEQ ID NO: 6432 - protein, 16 aa, Mus sp.
APINAFIGGLAAQEVM

SEQ ID NO: 6433 - protein, 15 aa, Mus sp.
ESKATYSTNSPVWEE

SEQ ID NO: 6434 - protein, 16 aa, Mus sp.
MPDMHFKTPKISMPDV

SEQ ID NO: 6435 - protein, 15 aa, Mus sp.
TPYSTPQMSPATTPA

SEQ ID NO: 6436 - protein, 20 aa, Mus sp.
EQRATFHTPEAPPNLAPAPP

SEQ ID NO: 6437 - protein, 16 aa, Mus sp.
DPSAFAAAAPAAAATT

SEQ ID NO: 6438 - protein, 15 aa, Mus sp.
INKMDDPTVNWSNER

SEQ ID NO: 6439 - protein, 18 aa, Mus sp.
DGDMRLVNGASANEGRVE

SEQ ID NO: 6440 - protein, 17 aa, Mus sp.
AAPHIYQNSFVQVVLNS

SEQ ID NO: 6441 - protein, 19 aa, Mus sp.
VVHKAFVEVNEEGTEAAAA

SEQ ID NO: 6442 - protein, 21 aa, Mus sp.
YPPPYPPAAFQGPSDHAAYPI

SEQ ID NO: 6443 - protein, 16 aa, Mus sp.
EVKAFFESHPAPSAER

SEQ ID NO: 6444 - protein, 13 aa, Mus sp.
IRSDWTNPEINKA

SEQ ID NO: 6445 - protein, 13 aa, Mus sp.
TPWKAPIVWEGTY

SEQ ID NO: 6446 - protein, 16 aa, Mus sp.
AVPPVFTQPTANIMPS

SEQ ID NO: 6447 - protein, 16 aa, Mus sp.
VRLVSQEPKALVSEWK

SEQ ID NO: 6448 - protein, 26 aa, Mus sp.
GEGGEATEQPGLNGAAAAAAAEAPDE

SEQ ID NO: 6449 - protein, 16 aa, Mus sp.
HFPDYRAAEVRETLNQ

SEQ ID NO: 6450 - protein, 20 aa, Mus sp.
DPEDHTVSFVQPNGAIFEPS

SEQ ID NO: 6451 - protein, 19 aa, Mus sp.
DAFKHAVSDPSILDSLDLN

SEQ ID NO: 6452 - protein, 17 aa, Mus sp.
TTSSYSNPTIGYENRVL

SEQ ID NO: 6453 - protein, 18 aa, Mus sp.
LVTEDNVFEAPTLVKVFK

SEQ ID NO: 6454 - protein, 15 aa, Mus sp.
GFPYEGPAPLEAIAN

SEQ ID NO: 6455 - protein, 13 aa, Mus sp.
ATNPIITPVAQEN

SEQ ID NO: 6456 - protein, 23 aa, Mus sp.
KPFPWGDGNHTLFHNPHVNPLPT

SEQ ID NO: 6457 - protein, 14 aa, Mus sp.
VDPYNNPVPRGLEA

SEQ ID NO: 6458 - protein, 15 aa, Mus sp.
DVYVFLGPEPKSVVQ

SEQ ID NO: 6459 - protein, 16 aa, Mus sp.
LFYLALPPTVYEAVTK

SEQ ID NO: 6460 - protein, 16 aa, Mus sp.
FINIYSASSVSEVNDG

SEQ ID NO: 6461 - protein, 12 aa, Mus sp.
NELDYYDSPSVN

SEQ ID NO: 6462 - protein, 16 aa, Mus sp.
KNVTELNEPLSNEERN

SEQ ID NO: 6463 - protein, 14 aa, Mus sp.
LLYNVPAVAEEIQD

SEQ ID NO: 6464 - protein, 13 aa, Mus sp.
FGNIYSTPLALQM

SEQ ID NO: 6465 - protein, 19 aa, Mus sp.
DPSQKQNLLAPQNAVSSEE

SEQ ID NO: 6466 - protein, 16 aa, Mus sp.
ADKTVKGPDGLTALEA

SEQ ID NO: 6467 - protein, 17 aa, Mus sp.
DPDSRGEYSWAVAQGVK

SEQ ID NO: 6468 - protein, 17 aa, Mus sp.
GGPGSAVSPYPSFNVSS

SEQ ID NO: 6469 - protein, 19 aa, Mus sp.
IPSPSSAFTPAHAATSSHA

SEQ ID NO: 6470 - protein, 16 aa, Mus sp.
DKDSFSDPYAHVSFLH

SEQ ID NO: 6471 - protein, 13 aa, Mus sp.
LEPYLEPRSPEAR

SEQ ID NO: 6472 - protein, 18 aa, Mus sp.
DYPYPTDFLGPLPANPVK

SEQ ID NO: 6473 - protein, 17 aa, Mus sp.
SEDNVYHSSNAVYRAPS

SEQ ID NO: 6474 - protein, 17 aa, Mus sp.
TPRDYYFALAHTVRDHL

SEQ ID NO: 6475 - protein, 14 aa, Mus sp.
GVAYEAPSLATGYG

SEQ ID NO: 6476 - protein, 14 aa, Mus sp.
STDYGNFLANEASP

SEQ ID NO: 6477 - protein, 23 aa, Mus sp.
DEDLETKKFRFEEPVVLPDLSDQ

SEQ ID NO: 6478 - protein, 13 aa, Mus sp.
ETTIWVSPSPILE

SEQ ID NO: 6479 - protein, 14 aa, Mus sp.
GIDPYDQPNAIYIE

SEQ ID NO: 6480 - protein, 15 aa, Mus sp.
ADASFVAAIPSTQVV

SEQ ID NO: 6481 - protein, 14 aa, Mus sp.
EPSVFNGPEVTMLK

SEQ ID NO: 6482 - protein, 13 aa, Mus sp.
LPSTWSDPSVNIS

SEQ ID NO: 6483 - protein, 14 aa, Mus sp.
IPVYRFVLPANAFA

SEQ ID NO: 6484 - protein, 21 aa, Mus sp.
EPPPPRSHYSNIEANESEEVR

SEQ ID NO: 6485 - protein, 16 aa, Mus sp.
KGVKYEAPQTTDGLAG

SEQ ID NO: 6486 - protein, 17 aa, Mus sp.
IGVGAYVSPDMMVAEYS

SEQ ID NO: 6487 - protein, 17 aa, Mus sp.
EAQVEFMASHGNEAARA

SEQ ID NO: 6488 - protein, 13 aa, Mus sp.
DEATRYLAPTILT

SEQ ID NO: 6489 - protein, 17 aa, Mus sp.
DVKKPAAAPAPAPAPAP

SEQ ID NO: 6490 - protein, 21 aa, Mus sp.
DYNRDGDSYRSPWSNKYDPPL

SEQ ID NO: 6491 - protein, 20 aa, Mus sp.
LVTEDNVFEAPTLVKVFKQP

SEQ ID NO: 6492 - protein, 15 aa, Mus sp.
GSDIFAAPAPQSTAT

SEQ ID NO: 6493 - protein, 17 aa, Mus sp.
VYIFYGASIASLSASHS

SEQ ID NO: 6494 - protein, 17 aa, Mus sp.
GQGVFREATTEFSVDAR

SEQ ID NO: 6495 - protein, 18 aa, Mus sp.
VDKDQSIAPKTTRVTYPA

SEQ ID NO: 6496 - protein, 16 aa, Mus sp.
APLDELVGAYPNYNEE

SEQ ID NO: 6497 - protein, 20 aa, Mus sp.
GFPKPPSYNVATTLPSYDEA

SEQ ID NO: 6498 - protein, 14 aa, Mus sp.
DNIFLSPLSISTAF

SEQ ID NO: 6499 - protein, 17 aa, Mus sp.
VPDVDISSPGINVEAPD

SEQ ID NO: 6500 - protein, 11 aa, Mus sp.
TPDYIAPEILQ

SEQ ID NO: 6501 - protein, 14 aa, Mus sp.
SSPYNPPDLEEAAK

SEQ ID NO: 6502 - protein, 20 aa, Mus sp.
APPKPQDAFSDSQPASAAES

SEQ ID NO: 6503 - protein, 15 aa, Mus sp.
RASIYQSVVINTSKE

SEQ ID NO: 6504 - protein, 15 aa, Mus sp.
LPNSFDGPVTITIVN

SEQ ID NO: 6505 - protein, 18 aa, Mus sp.
KLTGMAFRVPTPNVSVVD

SEQ ID NO: 6506 - protein, 11 aa, Mus sp.
AWTGPMGNWAM

SEQ ID NO: 6507 - protein, 17 aa, Mus sp.
VDEYDYSKPIQGQQKKP

SEQ ID NO: 6508 - protein, 14 aa, Mus sp.
KSKYKASIAALEAK

SEQ ID NO: 6509 - protein, 17 aa, Mus sp.
DKEKVIVDFSSPNIAKE

SEQ ID NO: 6510 - protein, 16 aa, Mus sp.
IFGTHHNPAVWPDPEV

SEQ ID NO: 6511 - protein, 29 aa, Mus sp.
QPGATTVQEQLRQLFERDWSSHYAMDLDR

SEQ ID NO: 6512 - protein, 16 aa, Mus sp.
KTLAYLFSGAAAAAEA

SEQ ID NO: 6513 - protein, 17 aa, Mus sp.
EFPDNYNSPTPYKIQYN

SEQ ID NO: 6514 - protein, 15 aa, Mus sp.
IPISKVKDVYVITDQ

SEQ ID NO: 6515 - protein, 15 aa, Mus sp.
KKWVNTPFTASSIEL

SEQ ID NO: 6516 - protein, 13 aa, Mus sp.
GPVPWLGPQTDEA

SEQ ID NO: 6517 - protein, 18 aa, Mus sp.
LEDPDGFSWPATLPSVYK

SEQ ID NO: 6518 - protein, 16 aa, Mus sp.
TIFQHHFPAAIDSFQD

SEQ ID NO: 6519 - protein, 16 aa, Mus sp.
EDKVYWTDVINEAIFS

SEQ ID NO: 6520 - protein, 14 aa, Mus sp.
TNDRYVASLAARNK

SEQ ID NO: 6521 - protein, 21 aa, Mus sp.
GPGEPSPVSETVVTPEAAPEK

SEQ ID NO: 6522 - protein, 20 aa, Mus sp.
YNRDGDSYRSPWSNKYDPPL

SEQ ID NO: 6523 - protein, 14 aa, Mus sp.
YALVYTSPVIPELK

SEQ ID NO: 6524 - protein, 11 aa, Mus sp.
HPIQWNAPEPS

SEQ ID NO: 6525 - protein, 21 aa, BOVIN
AGPPVASVVVGPSVVAVPLPL

SEQ ID NO: 6526 - protein, 15 aa, Mus sp.
VLVLDFVTPTPLGTR

SEQ ID NO: 6527 - protein, 15 aa, Mus sp.
FPLATYAPVISAEKA

SEQ ID NO: 6528 - protein, 16 aa, Mus sp.
YLLSQSSPAPLTAAEE

SEQ ID NO: 6529 - protein, 24 aa, Mus sp.
TPSPESPDQWSSSSPHSNISDWSE

SEQ ID NO: 6530 - protein, 21 aa, Mus sp.
SPLPVPVYAPKIPNQFRPDPP

SEQ ID NO: 6531 - protein, 17 aa, Mus sp.
STQLIRNGDWTFQVLVM

SEQ ID NO: 6532 - protein, 17 aa, Mus sp.
TVKSFVGPTPAPAPAPR

SEQ ID NO: 6533 - protein, 16 aa, Mus sp.
GTIRYMAPEVLEGAVN

SEQ ID NO: 6534 - protein, 17 aa, Mus sp.
TDRKIVYEGPELNHAFG

SEQ ID NO: 6535 - protein, 15 aa, Mus sp.
PLNSVFVAPAVTPVK

SEQ ID NO: 6536 - protein, 16 aa, Mus sp.
NQLEALVGPEANVGPY

SEQ ID NO: 6537 - protein, 19 aa, Mus sp.
APISSHTAPRPNPTPALPQ

SEQ ID NO: 6538 - protein, 14 aa, Mus sp.
AQTAYSANPASQAF

SEQ ID NO: 6539 - protein, 15 aa, Mus sp.
LPFGAYTNPFATPAQ

SEQ ID NO: 6540 - protein, 14 aa, Mus sp.
ECGENFSRISHLVQ

SEQ ID NO: 6541 - protein, 14 aa, Mus sp.
DEAYVQPEPLGVVL

SEQ ID NO: 6542 - protein, 16 aa, Mus sp.
RSQVTPSVPSEALDDS

SEQ ID NO: 6543 - protein, 15 aa, Mus sp.
TVTYEWAPPVQNQAL

SEQ ID NO: 6544 - protein, 15 aa, Mus sp.
ITYSYAGARAPMGQG

SEQ ID NO: 6545 - protein, 15 aa, Mus sp.
QLEALVGPEANVGPY

SEQ ID NO: 6546 - protein, 18 aa, Mus sp.
GPLDQVRAALPTPALTPE

SEQ ID NO: 6547 - protein, 16 aa, Mus sp.
DVQLVESGGGLVQPGG

SEQ ID NO: 6548 - protein, 14 aa, Mus sp.
FDFAGPAIHGSAVF

SEQ ID NO: 6549 - protein, 12 aa, Mus sp.
DNIFLSPLSIST

SEQ ID NO: 6550 - protein, 17 aa, Mus sp.
AEQEVLAPQVVLSLGGS

SEQ ID NO: 6551 - protein, 16 aa, Mus sp.
ASLELLEGKVLPGVDA

SEQ ID NO: 6552 - protein, 19 aa, Mus sp.
IDLKGIPVYRFVLPANAFA

SEQ ID NO: 6553 - protein, 14 aa, Mus sp.
INPEEYEHPNPWKE

SEQ ID NO: 6554 - protein, 16 aa, Mus sp.
SHPQYAEPGAEAAFSG

SEQ ID NO: 6555 - protein, 16 aa, Mus sp.
APKETTIWVSPSPILE

SEQ ID NO: 6556 - protein, 15 aa, Mus sp.
LFEDNMALPSESVSS

SEQ ID NO: 6557 - protein, 15 aa, Mus sp.
TTVSLSAPDALKIIT

SEQ ID NO: 6558 - protein, 20 aa, Mus sp.
EEKPVPAAPVPSPVAPAPVP

SEQ ID NO: 6559 - protein, 20 aa, Mus sp.
DGDLERFLSSAAAVSKEHPV

SEQ ID NO: 6560 - protein, 17 aa, Mus sp.
VIKSGYKIPELSQSLDY

SEQ ID NO: 6561 - protein, 14 aa, Mus sp.
AWVAFPLALVSGTV

SEQ ID NO: 6562 - protein, 25 aa, Mus sp.
GAGIIDVIKSGYKIPELSQSLDYIQ

SEQ ID NO: 6563 - protein, 21 aa, Mus sp.
HPDKGGSPYIAAKINEAKDLL

SEQ ID NO: 6564 - protein, 15 aa, Mus sp.
AAVAWEAGKPLSIEE

SEQ ID NO: 6565 - protein, 15 aa, Mus sp.
TPYYVAPEVLGPEKY

SEQ ID NO: 6566 - protein, 15 aa, Mus sp.
TPATNEAPQATVFPK

SEQ ID NO: 6567 - protein, 14 aa, Mus sp.
FPIKWTAPEAALFG

SEQ ID NO: 6568 - protein, 16 aa, Mus sp.
TSDIFGSPVTATAPLA

SEQ ID NO: 6569 - protein, 16 aa, Mus sp.
THDLYIQSHISENREE

SEQ ID NO: 6570 - protein, 19 aa, Mus sp.
KPVPAAPVPSPVAPAPVPS

SEQ ID NO: 6571 - protein, 16 aa, Mus sp.
AQAAMEEPVVQPSVVD

SEQ ID NO: 6572 - protein, 16 aa, Mus sp.
KSFVQNYPVVSIEDPF

SEQ ID NO: 6573 - protein, 15 aa, Mus sp.
EEEVEVFLPKFKLEE

SEQ ID NO: 6574 - protein, 14 aa, Mus sp.
IDQYQGADAVGLEE

SEQ ID NO: 6575 - protein, 15 aa, Mus sp.
VNSQYQEPDIIIHFA

SEQ ID NO: 6576 - protein, 16 aa, Mus sp.
LKRSYSSPDITQALQE

SEQ ID NO: 6577 - protein, 13 aa, Mus sp.
LSIQWESSRPLLA

SEQ ID NO: 6578 - protein, 16 aa, Mus sp.
IWRDYVPPTANLDQKD

SEQ ID NO: 6579 - protein, 8 aa, Mus sp.
TIIIFHSL

SEQ ID NO: 6580 - protein, 22 aa, Mus sp.
WDLVDAVTPSPQPSKEEDGPPA

SEQ ID NO: 6581 - protein, 15 aa, Mus sp.
LPNYSSPNALVLNTK

SEQ ID NO: 6582 - protein, 16 aa, Mus sp.
ADDTYTESYISTIGVD

SEQ ID NO: 6583 - protein, 14 aa, Mus sp.
LDIFNLPNVEISKD

SEQ ID NO: 6584 - protein, 18 aa, Mus sp.
KFGNSEFDPPGPNVATTT

SEQ ID NO: 6585 - protein, 20 aa, Mus sp.
APWDPQLSYAVSWAKVSESG

SEQ ID NO: 6586 - protein, 17 aa, Mus sp.
GVPTVPLLPPQVNQSLA

SEQ ID NO: 6587 - protein, 22 aa, Mus sp.
KPTVTVVSPLPNDSINPQPSPD

SEQ ID NO: 6588 - protein, 14 aa, Mus sp.
VKDGYQMAQPVFAP

SEQ ID NO: 6589 - protein, 22 aa, Mus sp.
EMEKEDRRYNPPIIHQGFQDTS

SEQ ID NO: 6590 - protein, 12 aa, Mus sp.
STQLIRNGDWTF

SEQ ID NO: 6591 - protein, 13 aa, Mus sp.
RTWNDPSVQQDIK

SEQ ID NO: 6592 - protein, 16 aa, Mus sp.
LSLLYNVPAVAEEIQD

SEQ ID NO: 6593 - protein, 14 aa, Mus sp.
VGGERFEAPEALFQ

SEQ ID NO: 6594 - protein, 16 aa, Mus sp.
DELSKTISPMVMDAKA

SEQ ID NO: 6595 - protein, 16 aa, Mus sp.
GQNAWFLPAQADIVAT

SEQ ID NO: 6596 - protein, 8 aa, Mus sp.
HIYEFPQL

SEQ ID NO: 6597 - protein, 17 aa, Mus sp.
IASFKDPKISTSLPVLD

SEQ ID NO: 6598 - protein, 14 aa, Mus sp.
DPYDQPNAIYIERH

SEQ ID NO: 6599 - protein, 11 aa, Mus sp.
FPYVTPAPHEP

SEQ ID NO: 6600 - protein, 19 aa, Mus sp.
TGTTVYRQFWIFDVQNPDD

SEQ ID NO: 6601 - protein, 12 aa, Mus sp.
IQEPYTFPAILK

SEQ ID NO: 6602 - protein, 15 aa, Mus sp.
GGKDFNMPLTISSLK

SEQ ID NO: 6603 - protein, 15 aa, Mus sp.
GDLSQHATPLPTPAV

SEQ ID NO: 6604 - protein, 16 aa, Mus sp.
EKPVPAAPVPSPVAPA

SEQ ID NO: 6605 - protein, 16 aa, Mus sp.
SVTYYGPSGQKTIYSE

SEQ ID NO: 6606 - protein, 13 aa, Mus sp.
FPYEGPAPLEAIA

SEQ ID NO: 6607 - protein, 16 aa, Mus sp.
ISALFVTPKTAGAQVV

SEQ ID NO: 6608 - protein, 18 aa, Mus sp.
HNDLQYAAPGGLIGVGTK

SEQ ID NO: 6609 - protein, 19 aa, Mus sp.
GNRITPSYVAFTPEGERLI

SEQ ID NO: 6610 - protein, 15 aa, Mus sp.
TPERLNSPVTIPAVM

SEQ ID NO: 6611 - protein, 16 aa, Mus sp.
VEPYEVHNPVPLIVGS

SEQ ID NO: 6612 - protein, 18 aa, Mus sp.
VDVFYSSGIPATARPYRP

SEQ ID NO: 6613 - protein, 10 aa, Mus sp.
VEKPFAIAKE

SEQ ID NO: 6614 - protein, 24 aa, Mus sp.
ITGLDPAGPNFEYAEAPSRLSPDD

SEQ ID NO: 6615 - protein, 17 aa, Mus sp.
TQSSCYISQLMFFMKSP

SEQ ID NO: 6616 - protein, 15 aa, Mus sp.
THDLYIQSHISENRE

SEQ ID NO: 6617 - protein, 26 aa, Mus sp.
LPNKPTVTVVSPLPNDSINPQPSPDG

SEQ ID NO: 6618 - protein, 17 aa, Mus sp.
DDDVYRAPPIDRSILPT

SEQ ID NO: 6619 - protein, 14 aa, Mus sp.
KPFQNPVPNQSPSS

SEQ ID NO: 6620 - protein, 17 aa, Mus sp.
ITGVDFIGSTVGLAKVS

SEQ ID NO: 6621 - protein, 17 aa, Mus sp.
DYVELPPSVSQAATSPP

SEQ ID NO: 6622 - protein, 13 aa, Mus sp.
KWKYEKPDGSPVF

SEQ ID NO: 6623 - protein, 14 aa, Mus sp.
AGNFYVPAEPKLAF

SEQ ID NO: 6624 - protein, 17 aa, Mus sp.
NSNKQYLFPETLVIGEK

SEQ ID NO: 6625 - protein, 15 aa, Mus sp.
LHLRFSAPQIENEPE

SEQ ID NO: 6626 - protein, 13 aa, Mus sp.
GTPEYLAPEIILS

SEQ ID NO: 6627 - protein, 16 aa, Mus sp.
GDSNFGAPSASVAAAP

SEQ ID NO: 6628 - protein, 20 aa, Mus sp.
KNPTDEYLDAMMNEAPGPIN

SEQ ID NO: 6629 - protein, 17 aa, Mus sp.
TGPPPYHESLAGASQPP

SEQ ID NO: 6630 - protein, 18 aa, Mus sp.
GSILWSQPLPSLPGGPPS

SEQ ID NO: 6631 - protein, 15 aa, Mus sp.
STPSYSIPEASFQDS

SEQ ID NO: 6632 - protein, 16 aa, Mus sp.
HTVSFVQPNGAIFEPS

SEQ ID NO: 6633 - protein, 16 aa, Mus sp.
VGAGHFRSPHTTEVVG

SEQ ID NO: 6634 - protein, 18 aa, Mus sp.
VDFVAWATGEPNFANDDE

SEQ ID NO: 6635 - protein, 13 aa, Mus sp.
INYQPPTVVPGGD

SEQ ID NO: 6636 - protein, 14 aa, Mus sp.
ALDTFNTSLVTPIY

SEQ ID NO: 6637 - protein, 18 aa, Mus sp.
ITSSYYRGAHGIIVVYDV

SEQ ID NO: 6638 - protein, 17 aa, Mus sp.
GDVVHGFYNPAVSRIVE

SEQ ID NO: 6639 - protein, 14 aa, Mus sp.
SNEFDYPSVGQLAH

SEQ ID NO: 6640 - protein, 15 aa, Mus sp.
DHVDFSQPEPHTVLF

SEQ ID NO: 6641 - protein, 14 aa, Mus sp.
TAYASYPSASVENY

SEQ ID NO: 6642 - protein, 17 aa, Mus sp.
VHKSFVEVNEEGTEAAA

SEQ ID NO: 6643 - protein, 17 aa, Mus sp.
AAPASAPTPSTPAPTPA

SEQ ID NO: 6644 - protein, 12 aa, Mus sp.
DAEYWNSQPEIL

SEQ ID NO: 6645 - protein, 16 aa, Mus sp.
DLVDAVTPSPQPSKEE

SEQ ID NO: 6646 - protein, 14 aa, Mus sp.
TPEFLAPEVLTDTS

SEQ ID NO: 6647 - protein, 16 aa, Mus sp.
GIPYFETSAANGTNIS

SEQ ID NO: 6648 - protein, 17 aa, Mus sp.
DPELPQFIQAKVNAINM

SEQ ID NO: 6649 - protein, 14 aa, Mus sp.
ADKEFHAPLIIDEN

SEQ ID NO: 6650 - protein, 16 aa, Mus sp.
LPFGAYTNPFATPAQA

SEQ ID NO: 6651 - protein, 21 aa, Mus sp.
DPETSVLILRKPGVSVASDWS

SEQ ID NO: 6652 - protein, 17 aa, Mus sp.
GEVKAFFESHPAPSAER

SEQ ID NO: 6653 - protein, 16 aa, Mus sp.
LNLAYIGAVPHSGIEQ

SEQ ID NO: 6654 - protein, 14 aa, Mus sp.
VTTDHISPAGNIAR

SEQ ID NO: 6655 - protein, 16 aa, Mus sp.
VQAFTHAPAALEADRG

SEQ ID NO: 6656 - protein, 16 aa, Mus sp.
KVNAVFSPKAASSPED

SEQ ID NO: 6657 - protein, 21 aa, Listeria monocytogenes
ESVYLSAQKENPRLFAKIETF

SEQ ID NO: 6658 - protein, 16 aa, Mus sp.
WKPGSDTIKPDVNKSK

SEQ ID NO: 6659 - protein, 14 aa, Mus sp.
VQWNDPGAQYSLVN

SEQ ID NO: 6660 - protein, 14 aa, Mus sp.
EVEHWFYPQENIID

SEQ ID NO: 6661 - protein, 17 aa, Mus sp.
VHLWRYEGGYPALTEVM

SEQ ID NO: 6662 - protein, 13 aa, Mus sp.
EVYTFPVPERHLE

SEQ ID NO: 6663 - protein, 12 aa, Mus sp.
FSYAFPKAVSVF

SEQ ID NO: 6664 - protein, 23 aa, Mus sp.
GPPGFEDYVELPPSVSQAAKSPP

SEQ ID NO: 6665 - protein, 15 aa, Mus sp.
EPPPAYEPPAPAPAP

SEQ ID NO: 6666 - protein, 18 aa, Mus sp.
LNVLRIINEPTAAAIAYG

SEQ ID NO: 6667 - protein, 19 aa, Mus sp.
KEDRRYNPPIIHQGFQDTS

SEQ ID NO: 6668 - protein, 15 aa, Mus sp.
SLLYNVPAVAEEIQD

SEQ ID NO: 6669 - protein, 13 aa, Mus sp.
GTSYQSPHGIPID

SEQ ID NO: 6670 - protein, 18 aa, Mus sp.
GPASEWTFSTPEGVPGHP

SEQ ID NO: 6671 - protein, 17 aa, Mus sp.
GPKVDIEGPNVNIEGPE

SEQ ID NO: 6672 - protein, 16 aa, Mus sp.
YAKVELVPPTPAEIPT

SEQ ID NO: 6673 - protein, 16 aa, Mus sp.
WKFTITPPSAQVVGVL

SEQ ID NO: 6674 - protein, 15 aa, Mus sp.
LAETVAPAVRGANPH

SEQ ID NO: 6675 - protein, 14 aa, Mus sp.
FPYEGPAPLEAIAN

SEQ ID NO: 6676 - protein, 14 aa, Mus sp.
YTRYHCSLPVPEPS

SEQ ID NO: 6677 - protein, 18 aa, Mus sp.
VIEDRDHYIPNTLNPVFG

SEQ ID NO: 6678 - protein, 19 aa, Mus sp.
SSSIASFKDPKISTSLPVL

SEQ ID NO: 6679 - protein, 14 aa, Mus sp.
RSYSSPDITQALQE

SEQ ID NO: 6680 - protein, 16 aa, Mus sp.
TIEFRGPNGLLVYQGK

SEQ ID NO: 6681 - protein, 16 aa, Mus sp.
RLDNYDAPDIANIAIS

SEQ ID NO: 6682 - protein, 20 aa, Mus sp.
NKPTVTVVSPLPNDSINPQP

SEQ ID NO: 6683 - protein, 16 aa, Mus sp.
SLHLRFSAPQIENEPE

SEQ ID NO: 6684 - protein, 15 aa, Mus sp.
AELQTLAPAINWLPF

SEQ ID NO: 6685 - protein, 16 aa, Mus sp.
IPEQSFYTKPLPGIIM

SEQ ID NO: 6686 - protein, 16 aa, Mus sp.
GDISISGPKVNVEAPN

SEQ ID NO: 6687 - protein, 15 aa, Mus sp.
SKATYSTNSPVWEEA

SEQ ID NO: 6688 - protein, 14 aa, Mus sp.
LDNYDAPDIANIAI

SEQ ID NO: 6689 - protein, 13 aa, Mus sp.
SDEGERYIAPTVL

SEQ ID NO: 6690 - protein, 11 aa, Mus sp.
LPYDTPVPGYM

SEQ ID NO: 6691 - protein, 16 aa, Mus sp.
WQKIQEPYTFPAILKS

SEQ ID NO: 6692 - protein, 15 aa, Mus sp.
GSVTYIAPPGNYDAS

SEQ ID NO: 6693 - protein, 22 aa, Mus sp.
YVDPTPDPNTAYASYPSASVEN

SEQ ID NO: 6694 - protein, 21 aa, Mus sp.
DQGNRITPSYVAFTPEGERLI

SEQ ID NO: 6695 - protein, 15 aa, Mus sp.
LTTSSYSNPTIGYEN

SEQ ID NO: 6696 - protein, 16 aa, Mus sp.
QPPTGYSTPTAPQAYS

SEQ ID NO: 6697 - protein, 28 aa, Mus sp.
EDDIEADHVGTYGISVYQSPGDIGQYTF

SEQ ID NO: 6698 - protein, 19 aa, Mus sp.
VPVPEFADSDPANIVHDFN

SEQ ID NO: 6699 - protein, 18 aa, Mus sp.
LPETFRRPQIDPAVEGFI

SEQ ID NO: 6700 - protein, 15 aa, Mus sp.
TIRYMAPEVLEGAVN

SEQ ID NO: 6701 - protein, 15 aa, Mus sp.
QNAWFLPAQADIVAT

SEQ ID NO: 6702 - protein, 19 aa, Mus sp.
SEPTTLFKTASALRSSAPL

SEQ ID NO: 6703 - protein, 16 aa, Mus sp.
DLPTTFQGATASTSYG

SEQ ID NO: 6704 - protein, 15 aa, Mus sp.
KPVPAAPVPSPVAPA

SEQ ID NO: 6705 - protein, 16 aa, Mus sp.
DNMFSGSKINYTENRA

SEQ ID NO: 6706 - protein, 16 aa, Mus sp.
DFDEEYFSSTSELAKD

SEQ ID NO: 6707 - protein, 17 aa, Mus sp.
APAPAPAAAPAPAPAAQ

SEQ ID NO: 6708 - protein, 17 aa, Mus sp.
EGNHYFYSPYPTKTQTM

SEQ ID NO: 6709 - protein, 12 aa, Mus sp.
AGWFDQIAVKVA

SEQ ID NO: 6710 - protein, 18 aa, Mus sp.
LADPSAFAAAAPAAAATT

SEQ ID NO: 6711 - protein, 16 aa, Mus sp.
KWKALYTDPKSSETAA

SEQ ID NO: 6712 - protein, 11 aa, Mus sp.
DYVPPTANLDQ

SEQ ID NO: 6713 - protein, 16 aa, Mus sp.
GGPGSAVSPYPSFNVS

SEQ ID NO: 6714 - protein, 15 aa, Mus sp.
STLIWAAPRLQSEVA

SEQ ID NO: 6715 - protein, 20 aa, Mus sp.
EGKLLEAKGPVTDVAYSHDG

SEQ ID NO: 6716 - protein, 16 aa, Mus sp.
LIDQCSHFEESLIKNL

SEQ ID NO: 6717 - protein, 17 aa, Mus sp.
NPEKHIYSSITTWETTE

SEQ ID NO: 6718 - protein, 15 aa, Mus sp.
VGTARYMAPEVLESR

SEQ ID NO: 6719 - protein, 16 aa, Mus sp.
NDLQYAAPGGLIGVGT

SEQ ID NO: 6720 - protein, 17 aa, Mus sp.
IGGDPFAAPQVVPAFAS

SEQ ID NO: 6721 - protein, 17 aa, Mus sp.
IAGVVYKDGIVLGADTR

SEQ ID NO: 6722 - protein, 17 aa, Mus sp.
SLLLHWQPPLSHNGVLT

SEQ ID NO: 6723 - protein, 14 aa, Mus sp.
WKALYTDPKSSETA

SEQ ID NO: 6724 - protein, 18 aa, Mus sp.
EPPPAYEPPAPAPAPLPP

SEQ ID NO: 6725 - protein, 15 aa, Mus sp.
FVAWATGEPNFANDD

SEQ ID NO: 6726 - protein, 15 aa, Mus sp.
LVEALEQPAPAIVSA

SEQ ID NO: 6727 - protein, 8 aa, Mus sp.
AAYEFTTL

SEQ ID NO: 6728 - protein, 16 aa, Mus sp.
YDKYFTNPQISQGVPG

SEQ ID NO: 6729 - protein, 16 aa, Mus sp.
GGLPDYSAPNPIKVTH

SEQ ID NO: 6730 - protein, 14 aa, Mus sp.
LGEFDTPEAIWSSE

SEQ ID NO: 6731 - protein, 16 aa, Mus sp.
VAVNWYAPLVAPISKD

SEQ ID NO: 6732 - protein, 26 aa, Mus sp.
APAPAAPAAAEPQAEAPAAAASSEQS

SEQ ID NO: 6733 - protein, 19 aa, Mus sp.
YVDLDKKETVWMLPEFGQL

SEQ ID NO: 6734 - protein, 13 aa, Mus sp.
EVWERPLSNLAWA

SEQ ID NO: 6735 - protein, 16 aa, Mus sp.
LQNLYMQWNKISVIGQ

SEQ ID NO: 6736 - protein, 20 aa, Mus sp.
DLYTAKGLFRAAVPSGASTG

SEQ ID NO: 6737 - protein, 15 aa, Mus sp.
ATLEIKGPQADLIDA

SEQ ID NO: 6738 - protein, 11 aa, Mus sp.
DYFKGAIPIRK

SEQ ID NO: 6739 - protein, 15 aa, Mus sp.
AFPFESGKPFKIQVL

SEQ ID NO: 6740 - protein, 15 aa, Mus sp.
EEVNIKTAEAQLAYE

SEQ ID NO: 6741 - protein, 11 aa, Mus sp.
GIYTYGKPVPG

SEQ ID NO: 6742 - protein, 18 aa, Mus sp.
EKEDRRYNPPIIHQGFQD

SEQ ID NO: 6743 - protein, 14 aa, Mus sp.
DFVAWATGEPNFAN

SEQ ID NO: 6744 - protein, 25 aa, Mus sp.
LSPDDADFVDVLHTFTRGSPGRSIG

SEQ ID NO: 6745 - protein, 17 aa, Mus sp.
DVPFTLAPHVLAAQGTI

SEQ ID NO: 6746 - protein, 15 aa, Mus sp.
KVPYVAQEIQEEIDE

SEQ ID NO: 6747 - protein, 15 aa, Mus sp.
ITPDIIINPHAIPSR

SEQ ID NO: 6748 - protein, 17 aa, Mus sp.
VLDNYLTSPLPEEVDET

SEQ ID NO: 6749 - protein, 16 aa, Mus sp.
GAPFDWEGAQASQALL

SEQ ID NO: 6750 - protein, 22 aa, BOVIN
AGPPVASVVVGPSVVAVPLPLH

SEQ ID NO: 6751 - protein, 18 aa, Mus sp.
SILDRYYTPTISRERAVE

SEQ ID NO: 6752 - protein, 16 aa, Mus sp.
EDRRYNPPIIHQGFQD

SEQ ID NO: 6753 - protein, 17 aa, Mus sp.
SSPDIFDSPSPEEDKEE

SEQ ID NO: 6754 - protein, 14 aa, Mus sp.
GVLLPFFDPDTNIV

SEQ ID NO: 6755 - protein, 16 aa, Mus sp.
SLQAFSNPSAGISVDV

SEQ ID NO: 6756 - protein, 15 aa, Mus sp.
KKAGYITPVPGGVGP

SEQ ID NO: 6757 - protein, 12 aa, Mus sp.
IVKYELPLVIKA

SEQ ID NO: 6758 - protein, 15 aa, Mus sp.
SPVFSPANPESSIED

SEQ ID NO: 6759 - protein, 15 aa, Mus sp.
LAWVAFPLALVSGTV

SEQ ID NO: 6760 - protein, 15 aa, Mus sp.
GYDPIISPEVAASFG

SEQ ID NO: 6761 - protein, 15 aa, Mus sp.
GNSEFDPPGPNVATT

SEQ ID NO: 6762 - protein, 17 aa, Mus sp.
FWPPVTNTEMFVTAPDN

SEQ ID NO: 6763 - protein, 18 aa, Mus sp.
ASLEDFYGSPIPSVSLKL

SEQ ID NO: 6764 - protein, 13 aa, Mus sp.
EFMGPEVAPALPD

SEQ ID NO: 6765 - protein, 18 aa, Mus sp.
EPTSSSPYNPPDLEEAAK

SEQ ID NO: 6766 - protein, 13 aa, Mus sp.
EDFYGSPIPSVSL

SEQ ID NO: 6767 - protein, 15 aa, Mus sp.
EEAFHPREMKAEDED

SEQ ID NO: 6768 - protein, 18 aa, Mus sp.
LLKGQMGLYIFQNTHAID

SEQ ID NO: 6769 - protein, 16 aa, Mus sp.
APPLPIKTPIPTPSTL

SEQ ID NO: 6770 - protein, 16 aa, Mus sp.
GSPAFQPPEIANGLDT

SEQ ID NO: 6771 - protein, 15 aa, Mus sp.
YENVQVSPVPGGPPG

SEQ ID NO: 6772 - protein, 19 aa, Mus sp.
DIDTAAKFIGAGAATVGVA

SEQ ID NO: 6773 - protein, 18 aa, Mus sp.
SLKYHFVTPLTSMVVTKP

SEQ ID NO: 6774 - protein, 20 aa, Mus sp.
DDGHGGYKPFQNPVPNQSPS

SEQ ID NO: 6775 - protein, 19 aa, Mus sp.
LITGVDFIGSTVGLAKVSA

SEQ ID NO: 6776 - protein, 18 aa, Mus sp.
KVEPYEVHNPVPLIVGSS

SEQ ID NO: 6777 - protein, 15 aa, Mus sp.
VELPPSVSQAAKSPP

SEQ ID NO: 6778 - protein, 18 aa, Mus sp.
NNAYYLDKMHYSIEGKDT

SEQ ID NO: 6779 - protein, 17 aa, Mus sp.
IPETYPFNPPKVRFITK

SEQ ID NO: 6780 - protein, 17 aa, Mus sp.
EIQPFHRAAAIQAISLD

SEQ ID NO: 6781 - protein, 17 aa, Mus sp.
KPTVTVVSPLPNDSINP

SEQ ID NO: 6782 - protein, 17 aa, Mus sp.
IIEQSWGSPKVTKDGVT

SEQ ID NO: 6783 - protein, 12 aa, Mus sp.
LKYHFVTPLTSM

SEQ ID NO: 6784 - protein, 15 aa, Mus sp.
KDGYQMAQPVFAPKN

SEQ ID NO: 6785 - protein, 17 aa, Mus sp.
VDAGNAFKKADPQEAIN

SEQ ID NO: 6786 - protein, 16 aa, Mus sp.
EDLNYHDPTVKHSTFH

SEQ ID NO: 6787 - protein, 18 aa, Mus sp.
EDPDGFSWPATLPSVYKQ

SEQ ID NO: 6788 - protein, 16 aa, Mus sp.
QRYSYQYTVANKEYVA

SEQ ID NO: 6789 - protein, 22 aa, Listeria monocytogenes
VMASDYTRGLSIRAIELVFENL

SEQ ID NO: 6790 - protein, 15 aa, Mus sp.
IYEGYALPHAILRLD

SEQ ID NO: 6791 - protein, 16 aa, Mus sp.
FPGAQHYVGGNAALIG

SEQ ID NO: 6792 - protein, 12 aa, Mus sp.
RDYVPPTANLDQ

SEQ ID NO: 6793 - protein, 14 aa, Mus sp.
EDKVYWTDVINEAI

SEQ ID NO: 6794 - protein, 19 aa, Mus sp.
EKEDRRYNPPIIHQGFQDT

SEQ ID NO: 6795 - protein, 15 aa, Mus sp.
GQLPDYTSPVVLPYS

SEQ ID NO: 6796 - protein, 17 aa, Mus sp.
AGEEDWTISPVPQSIVD

SEQ ID NO: 6797 - protein, 16 aa, Mus sp.
GEEDWTISPVPQSIVD

SEQ ID NO: 6798 - protein, 11 aa, Mus sp.
AELLNSKLPRW

SEQ ID NO: 6799 - protein, 15 aa, Mus sp.
SVAFIKPGVNKAEVT

SEQ ID NO: 6800 - protein, 16 aa, Mus sp.
SGLEVVAPEVTSAPVS

SEQ ID NO: 6801 - protein, 18 aa, Mus sp.
YPRDISNYGFPRSVQAID

SEQ ID NO: 6802 - protein, 15 aa, Mus sp.
GTPDYIAPEIIAYQP

SEQ ID NO: 6803 - protein, 20 aa, Mus sp.
LEALGHMFMYFLRGSLPWQG

SEQ ID NO: 6804 - protein, 16 aa, Mus sp.
KYHFVTPLTSMVVTKP

SEQ ID NO: 6805 - protein, 15 aa, Mus sp.
LSEGFSSPSSLMSPS

SEQ ID NO: 6806 - protein, 12 aa, Mus sp.
EEYSAPLPTPAP

SEQ ID NO: 6807 - protein, 14 aa, Mus sp.
ISNYGFPRSVQAID

SEQ ID NO: 6808 - protein, 16 aa, Mus sp.
SDPKPYSPKLSVIPTS

SEQ ID NO: 6809 - protein, 17 aa, Mus sp.
GMAFRVPTPNVSVVDLT

SEQ ID NO: 6810 - protein, 13 aa, Mus sp.
QIDYTVPTVIAEE

SEQ ID NO: 6811 - protein, 25 aa, Mus sp.
GPGEPSPVSETVVTPEAAPEKNPVD

SEQ ID NO: 6812 - protein, 14 aa, Mus sp.
FTITPPSAQVVGVL

SEQ ID NO: 6813 - protein, 16 aa, Mus sp.
PLNSVFVAPAVTPVKG

SEQ ID NO: 6814 - protein, 15 aa, Mus sp.
TPDYIAPEILQGLKY

SEQ ID NO: 6815 - protein, 20 aa, Mus sp.
FAAEEFKVPAATSAIITNDG

SEQ ID NO: 6816 - protein, 17 aa, Mus sp.
TGYPTAYPAAAPAYNPS

SEQ ID NO: 6817 - protein, 19 aa, Mus sp.
EPTSSSPYNPPDLEEAAKT

SEQ ID NO: 6818 - protein, 9 aa, Mus sp.
IPFYTPIPN

SEQ ID NO: 6819 - protein, 14 aa, Mus sp.
DLSQHATPLPTPAV

SEQ ID NO: 6820 - protein, 19 aa, Listeria monocytogenes
TVRAKSKTYPVYINEFALE

SEQ ID NO: 6821 - protein, 16 aa, Mus sp.
LHLRFSAPQIENEPET

SEQ ID NO: 6822 - protein, 17 aa, Mus sp.
VLVFDVTAPNTFKTLDS

SEQ ID NO: 6823 - protein, 14 aa, Mus sp.
DNYRFAHTNIESLV

SEQ ID NO: 6824 - protein, 14 aa, Mus sp.
IPDYWDPAALPDLG

SEQ ID NO: 6825 - protein, 19 aa, Mus sp.
FIHKSVVEVNEEGTEAAAA

SEQ ID NO: 6826 - protein, 15 aa, Mus sp.
LSYREPDPEDAVGGS

SEQ ID NO: 6827 - protein, 14 aa, Mus sp.
TPATNEAPQATVFP

SEQ ID NO: 6828 - protein, 19 aa, Mus sp.
EAARDNMFSGSKINYTENR

SEQ ID NO: 6829 - protein, 16 aa, Mus sp.
LYPDTAGPEAALEAED

SEQ ID NO: 6830 - protein, 15 aa, Mus sp.
DLKWGTPVPLEGFED

SEQ ID NO: 6831 - protein, 17 aa, Listeria monocytogenes
GINQAYTGSTALSDGLN

SEQ ID NO: 6832 - protein, 15 aa, Mus sp.
YPNFAGPQAALANKS

SEQ ID NO: 6833 - protein, 17 aa, Mus sp.
YLPETFRRPQIDPAVEG

SEQ ID NO: 6834 - protein, 20 aa, Mus sp.
VTEDNVFEAPTLVKVFKQPS

SEQ ID NO: 6835 - protein, 16 aa, Mus sp.
KGPAFVNPLIPENKEE

SEQ ID NO: 6836 - protein, 13 aa, Mus sp.
RKIVYEGPELNHA

SEQ ID NO: 6837 - protein, 18 aa, Mus sp.
DTSSKVIQSVANYAKGDL

SEQ ID NO: 6838 - protein, 17 aa, Mus sp.
VGTARYMAPEVLESRMN

SEQ ID NO: 6839 - protein, 16 aa, Mus sp.
GPYDFYQHPNVAEARQ

SEQ ID NO: 6840 - protein, 18 aa, Mus sp.
CASLLRARLLLQLAQSQQ

SEQ ID NO: 6841 - protein, 16 aa, Mus sp.
IPEAQWQSSLARTSSA

SEQ ID NO: 6842 - protein, 11 aa, Mus sp.
QVTQPTVGMNF

SEQ ID NO: 6843 - protein, 15 aa, Mus sp.
ERASFITPVPGGVGP

SEQ ID NO: 6844 - protein, 12 aa, Mus sp.
GTPDYIAPEILQ

SEQ ID NO: 6845 - protein, 14 aa, Mus sp.
VADKEFHAPLIIDE

SEQ ID NO: 6846 - protein, 11 aa, Mus sp.
DIEADHVGTYG

SEQ ID NO: 6847 - protein, 15 aa, Mus sp.
AIFSYEAAQPEDLEF

SEQ ID NO: 6848 - protein, 17 aa, Mus sp.
LLEAKGPVTDVAYSHDG

SEQ ID NO: 6849 - protein, 17 aa, Mus sp.
APAAATSAPAPAPAPAP

SEQ ID NO: 6850 - protein, 15 aa, Mus sp.
RDNMFSGSKINYTEN

SEQ ID NO: 6851 - protein, 13 aa, Mus sp.
ELWDSPEPASAPR

SEQ ID NO: 6852 - protein, 20 aa, Mus sp.
VQIPKVVKSPSSLPAKPLVP

SEQ ID NO: 6853 - protein, 14 aa, Mus sp.
SKATYSTNSPVWEE

SEQ ID NO: 6854 - protein, 14 aa, Mus sp.
INDYKGAVIVVSHD

SEQ ID NO: 6855 - protein, 15 aa, Mus sp.
AFDTRAPMAAQGMVE

SEQ ID NO: 6856 - protein, 15 aa, Mus sp.
VIHFNNPKVQASLAA

SEQ ID NO: 6857 - protein, 25 aa, Mus sp.
DAGTIAGLNVMRIINEPTAAAIAYG

SEQ ID NO: 6858 - protein, 14 aa, Mus sp.
TQLIRNGDWTFQVL

SEQ ID NO: 6859 - protein, 14 aa, Mus sp.
QIYYAGPVNNPGLD

SEQ ID NO: 6860 - protein, 19 aa, Mus sp.
IARQNFTEPTAIQAQGWPV

SEQ ID NO: 6861 - protein, 16 aa, Mus sp.
EEEEVEVFLPKFKLEE

SEQ ID NO: 6862 - protein, 29 aa, Mus sp.
GGLDSLIGDSNFGAPSASVAAAPAPARLG

SEQ ID NO: 6863 - protein, 21 aa, Mus sp.
YPPPPQSDSASSPSPSFSEDN

SEQ ID NO: 6864 - protein, 19 aa, Mus sp.
VGTPDYISPEVLKSQGGDG

SEQ ID NO: 6865 - protein, 15 aa, Mus sp.
IDQYQGADAVGLEEK

SEQ ID NO: 6866 - protein, 13 aa, Mus sp.
VFDVTAPNTFKTL

SEQ ID NO: 6867 - protein, 16 aa, Mus sp.
GLEEPVLKHWEPEIPA

SEQ ID NO: 6868 - protein, 16 aa, Mus sp.
GTKRYMAPEVLDDSIN

SEQ ID NO: 6869 - protein, 17 aa, Mus sp.
SPCANDVALIGFMMKPS

SEQ ID NO: 6870 - protein, 15 aa, Mus sp.
NINQWTASIVEQSIT

SEQ ID NO: 6871 - protein, 15 aa, Mus sp.
TPAYTIPFYTPIPNG

SEQ ID NO: 6872 - protein, 13 aa, Mus sp.
TARYMAPEVLESR

SEQ ID NO: 6873 - protein, 15 aa, Mus sp.
ITDKFWGPSGAESVI

SEQ ID NO: 6874 - protein, 18 aa, Mus sp.
LDKDSFSDPYAHVSFLHR

SEQ ID NO: 6875 - protein, 15 aa, Mus sp.
LEALVGPEANVGPYG

SEQ ID NO: 6876 - protein, 18 aa, Mus sp.
STHSNSISFGSAPTTSVS

SEQ ID NO: 6877 - protein, 16 aa, Mus sp.
AQTAYSANPASQAFVL

SEQ ID NO: 6878 - protein, 18 aa, Mus sp.
DSSRLPSEGPQPAHVVVG

SEQ ID NO: 6879 - protein, 15 aa, Mus sp.
AVDALASSHPLSSPA

SEQ ID NO: 6880 - protein, 20 aa, Mus sp.
YPTPAYTIPFYTPIPNGLYP

SEQ ID NO: 6881 - protein, 18 aa, Mus sp.
VTTDHISPAGNIARNSPA

SEQ ID NO: 6882 - protein, 18 aa, Mus sp.
GEVKAFFESHPAPSAERT

SEQ ID NO: 6883 - protein, 12 aa, Mus sp.
YNPPIIHQGFQD

SEQ ID NO: 6884 - protein, 14 aa, Mus sp.
VATNPIITPVAQEN

SEQ ID NO: 6885 - protein, 18 aa, Mus sp.
IESKEAFQEALAAAGDKL

SEQ ID NO: 6886 - protein, 12 aa, Mus sp.
VFVAPAVTPVKG

SEQ ID NO: 6887 - protein, 15 aa, Mus sp.
IPPTHYAASRAASVA

SEQ ID NO: 6888 - protein, 12 aa, Mus sp.
KQIVWNGPVGVF

SEQ ID NO: 6889 - protein, 20 aa, Mus sp.
KGEQIYYAGPVNNPGLDVPQ

SEQ ID NO: 6890 - protein, 17 aa, Mus sp.
NNIPYFETSAKEAINVE

SEQ ID NO: 6891 - protein, 21 aa, Mus sp.
NGNPLNSVFVAPAVTPVKGVL

SEQ ID NO: 6892 - protein, 15 aa, Mus sp.
MYPTGAPGAQAAPQA

SEQ ID NO: 6893 - protein, 15 aa, Mus sp.
YVPWNFHEPQPGQYE

SEQ ID NO: 6894 - protein, 16 aa, Mus sp.
TDKFWGPSGAESVIGG

SEQ ID NO: 6895 - protein, 18 aa, Mus sp.
GPRAEEYEFLTPMEEAPK

SEQ ID NO: 6896 - protein, 15 aa, Mus sp.
DSQYRASAPNSHVPL

SEQ ID NO: 6897 - protein, 23 aa, Mus sp.
GPSAPATPAAEAKAAEAAASAYY

SEQ ID NO: 6898 - protein, 18 aa, Mus sp.
KKELEEQLGPVAEETRAR

SEQ ID NO: 6899 - protein, 17 aa, Mus sp.
TTVSLSAPDALKIITEN

SEQ ID NO: 6900 - protein, 18 aa, Mus sp.
LDIYVWRGAQATLSNTTK

SEQ ID NO: 6901 - protein, 17 aa, Mus sp.
ASLEDFYGSPIPSVSLK

SEQ ID NO: 6902 - protein, 15 aa, Mus sp.
APYQGPDAAPGALDY

SEQ ID NO: 6903 - protein, 17 aa, Mus sp.
HGSLFLKTPKIVSSKDY

SEQ ID NO: 6904 - protein, 15 aa, Mus sp.
DPSAFAAAAPAAAAT

SEQ ID NO: 6905 - protein, 17 aa, Mus sp.
TVTPWKAPIVWEGTYDT

SEQ ID NO: 6906 - protein, 14 aa, Mus sp.
NYEYYASHVPESVK

SEQ ID NO: 6907 - protein, 16 aa, Mus sp.
SNKQYLFPETLVIGEK

SEQ ID NO: 6908 - protein, 13 aa, Mus sp.
IKVYWDAPSPAPD

SEQ ID NO: 6909 - protein, 16 aa, Mus sp.
YTPYYVAPEVLGPEKY

SEQ ID NO: 6910 - protein, 15 aa, Mus sp.
KRSNEFDYPSVGQLA

SEQ ID NO: 6911 - protein, 20 aa, Mus sp.
QLQPQPATLLGKAGAFPPPA

SEQ ID NO: 6912 - protein, 12 aa, Mus sp.
VTQFHPPHIEIQ

SEQ ID NO: 6913 - protein, 20 aa, Mus sp.
LPDDINVYATTAANPKESSY

SEQ ID NO: 6914 - protein, 26 aa, Mus sp.
VEWTNNGKTELNYKNTEPVLDSDGSY

SEQ ID NO: 6915 - protein, 17 aa, Mus sp.
RPPADFTQPAAAAAAAA

SEQ ID NO: 6916 - protein, 13 aa, Mus sp.
LPAAAQAPDALPA

SEQ ID NO: 6917 - protein, 10 aa, Mus sp.
YTPIPNGLYP

SEQ ID NO: 6918 - protein, 15 aa, Mus sp.
HWGEWSPAHPLEAED

SEQ ID NO: 6919 - protein, 15 aa, Mus sp.
KPSGYNPPISILGIL

SEQ ID NO: 6920 - protein, 12 aa, Mus sp.
LYNQVKDLQEQN

SEQ ID NO: 6921 - protein, 9 aa, Mus sp.
QILSDFPKL

SEQ ID NO: 6922 - protein, 16 aa, Mus sp.
IEVDQIYHLASPASPP

SEQ ID NO: 6923 - protein, 17 aa, Mus sp.
TKNLDYVATSIHEAVTK

SEQ ID NO: 6924 - protein, 20 aa, Mus sp.
NWPHLEEARVVAVSDGETKF

SEQ ID NO: 6925 - protein, 16 aa, Mus sp.
GEPYMYLSPLQQAVSD

SEQ ID NO: 6926 - protein, 16 aa, Mus sp.
VTVVSPLPNDSINPQP

SEQ ID NO: 6927 - protein, 16 aa, Mus sp.
SEEEYSAPLPTPAPSS

SEQ ID NO: 6928 - protein, 15 aa, Mus sp.
TITVQGPKSSRSLPV

SEQ ID NO: 6929 - protein, 15 aa, Mus sp.
LGVAYEAPSLATGYG

SEQ ID NO: 6930 - protein, 15 aa, Mus sp.
IYYAGPVNNPGLDVP

SEQ ID NO: 6931 - protein, 14 aa, Mus sp.
VEFSAPYPMEVIFE

SEQ ID NO: 6932 - protein, 19 aa, Mus sp.
SDMNDAYLGYASAVILRNR

SEQ ID NO: 6933 - protein, 20 aa, Mus sp.
KIQASVATNPIITPVAQENQ

SEQ ID NO: 6934 - protein, 16 aa, Mus sp.
EGPEASTPMPSPSPSP

SEQ ID NO: 6935 - protein, 15 aa, Mus sp.
FGTGHSAPSASPAFG

SEQ ID NO: 6936 - protein, 17 aa, Mus sp.
TSNDVHMYLPTKLFQPS

SEQ ID NO: 6937 - protein, 16 aa, Mus sp.
IDPYDQPNAIYIERHE

SEQ ID NO: 6938 - protein, 15 aa, Mus sp.
IKIAWESPQGQVSRY

SEQ ID NO: 6939 - protein, 14 aa, Mus sp.
LPNYSSPNALVLNT

SEQ ID NO: 6940 - protein, 13 aa, Mus sp.
VGAWTGPMGNWAM

SEQ ID NO: 6941 - protein, 15 aa, Mus sp.
IEGYVPSQADVAVFE

SEQ ID NO: 6942 - protein, 19 aa, Mus sp.
GIDPYDQPNAIYIERHEPF

SEQ ID NO: 6943 - protein, 17 aa, Mus sp.
VPYPRIHFPLATYAPVI

SEQ ID NO: 6944 - protein, 17 aa, Mus sp.
TDINAFVGAVSLTAADS

SEQ ID NO: 6945 - protein, 14 aa, Mus sp.
ERASFITPVPGGVG

SEQ ID NO: 6946 - protein, 17 aa, Mus sp.
ADKTVKGPDGLTALEAT

SEQ ID NO: 6947 - protein, 18 aa, Mus sp.
APDAWDYSQGFVNEEMIR

SEQ ID NO: 6948 - protein, 11 aa, Mus sp.
ERFPDENFKLK

SEQ ID NO: 6949 - protein, 14 aa, Mus sp.
DLDETRQAIVNAAK

SEQ ID NO: 6950 - protein, 20 aa, Mus sp.
NNLGLFINHYPNGVVTVNCA

SEQ ID NO: 6951 - protein, 15 aa, Mus sp.
GGQVYAFPSSQSVTE

SEQ ID NO: 6952 - protein, 13 aa, Mus sp.
GPPIFNPVANEVY

SEQ ID NO: 6953 - protein, 15 aa, Mus sp.
FFWNVAPGAESAVAS

SEQ ID NO: 6954 - protein, 17 aa, Mus sp.
SLESFLGPRANTEDLPF

SEQ ID NO: 6955 - protein, 16 aa, Mus sp.
GPNFEYAEAPSRLSPD

SEQ ID NO: 6956 - protein, 17 aa, Mus sp.
DERFGVRFPAMSDAYDR

SEQ ID NO: 6957 - protein, 13 aa, Mus sp.
NDLQYAAPGGLIG

SEQ ID NO: 6958 - protein, 15 aa, Mus sp.
DPKLTYHGFTLEDAA

SEQ ID NO: 6959 - protein, 15 aa, Mus sp.
KGSVFSAPSASGTPN

SEQ ID NO: 6960 - protein, 15 aa, Mus sp.
FVHFFAPQGLPVVPK

SEQ ID NO: 6961 - protein, 17 aa, Mus sp.
DEQEFVYKEPAITKLPE

SEQ ID NO: 6962 - protein, 15 aa, Mus sp.
TGMAFRVPTPNVSVV

SEQ ID NO: 6963 - protein, 18 aa, Mus sp.
DLERFLSSAAAVSKEHPV

SEQ ID NO: 6964 - protein, 17 aa, Mus sp.
VSTLIWAAPRLQSEVAE

SEQ ID NO: 6965 - protein, 27 aa, Mus sp.
LSPDDADFVDVLHTFTRGSPGRSIGIQ

SEQ ID NO: 6966 - protein, 20 aa, Mus sp.
DDGTVIHFNNPKVQASLSAN

SEQ ID NO: 6967 - protein, 16 aa, Mus sp.
STLIWAAPRLQSEVAE

SEQ ID NO: 6968 - protein, 19 aa, Mus sp.
TPAAPTSALGPKASPAPSH

SEQ ID NO: 6969 - protein, 13 aa, Mus sp.
SIVYWMTSQPSDA

SEQ ID NO: 6970 - protein, 18 aa, Mus sp.
TGTTVYRQFWIFDVQNPD

SEQ ID NO: 6971 - protein, 15 aa, Mus sp.
VPATFAPSPTPAVVS

SEQ ID NO: 6972 - protein, 20 aa, Mus sp.
DLDEQEFVYKEPAITKLPEI

SEQ ID NO: 6973 - protein, 17 aa, Mus sp.
ITSSYYRGAHGIIVVYD

SEQ ID NO: 6974 - protein, 16 aa, Mus sp.
FADDYTTANARKLIDE

SEQ ID NO: 6975 - protein, 13 aa, Mus sp.
DPAWEAPEGVPID

SEQ ID NO: 6976 - protein, 15 aa, Mus sp.
ISNYGFPRSVQAIDA

SEQ ID NO: 6977 - protein, 15 aa, Mus sp.
WKFTITPPSAQVVGV

SEQ ID NO: 6978 - protein, 15 aa, Mus sp.
FPIKWTAPEAINFGS

SEQ ID NO: 6979 - protein, 13 aa, Mus sp.
LDEFYSDPHAVAG

SEQ ID NO: 6980 - protein, 17 aa, Mus sp.
EPIKSFEAPATINSASL

SEQ ID NO: 6981 - protein, 13 aa, Mus sp.
DIYVWRGAQATLS

SEQ ID NO: 6982 - protein, 27 aa, Mus sp.
IPISKVKDVYVITDQIPVFVTMSQKND

SEQ ID NO: 6983 - protein, 20 aa, Mus sp.
WGIDPYDQPNAIYIERHEPF

SEQ ID NO: 6984 - protein, 18 aa, Mus sp.
TDINAFVGAVSLTAADSN

SEQ ID NO: 6985 - protein, 16 aa, Mus sp.
YAVDIRSPAISWVNNL

SEQ ID NO: 6986 - protein, 14 aa, Mus sp.
SPNYAAPEVISGRL

SEQ ID NO: 6987 - protein, 19 aa, Mus sp.
DDERVVGFHVLGPNAGEVT

SEQ ID NO: 6988 - protein, 19 aa, Mus sp.
GLSGAEGARGPPGFKGHTG

SEQ ID NO: 6989 - protein, 16 aa, Mus sp.
KAVDVFFPPEAQNDFP

SEQ ID NO: 6990 - protein, 14 aa, Mus sp.
LEALVGPEANVGPY

SEQ ID NO: 6991 - protein, 13 aa, Mus sp.
VAYEAPSLATGYG

SEQ ID NO: 6992 - protein, 27 aa, Mus sp.
VIPELNGKLTGMAFRVPTPNVSVVDLT

SEQ ID NO: 6993 - protein, 18 aa, Mus sp.
DLPNSFDGPVTITIVNRD

SEQ ID NO: 6994 - protein, 16 aa, Mus sp.
VTEDNVFEAPTLVKVF

SEQ ID NO: 6995 - protein, 14 aa, Mus sp.
ADDTYTESYISTIG

SEQ ID NO: 6996 - protein, 15 aa, Mus sp.
ESEEEYSAPLPTPAP

SEQ ID NO: 6997 - protein, 13 aa, Mus sp.
EQIYYAGPVNNPG

SEQ ID NO: 6998 - protein, 25 aa, Mus sp.
LPNKPTVTVVSPLPNDSINPQPSPD

SEQ ID NO: 6999 - protein, 15 aa, Mus sp.
EGPRYLSSTAVVVAE

SEQ ID NO: 7000 - protein, 15 aa, Mus sp.
TEDNVFEAPTLVKVF

SEQ ID NO: 7001 - protein, 15 aa, Mus sp.
TDLRFQSSAVMALQE

SEQ ID NO: 7002 - protein, 18 aa, Mus sp.
VQIPKVVKSPSSLPAKPL

SEQ ID NO: 7003 - protein, 18 aa, Mus sp.
LPQLRNVGGVRAIPYMQV

SEQ ID NO: 7004 - protein, 16 aa, Mus sp.
GVDFIGSTVGLAKVSA

SEQ ID NO: 7005 - protein, 17 aa, Mus sp.
GPGSAVSPYPSFNVSSD

SEQ ID NO: 7006 - protein, 17 aa, Mus sp.
ESEEEYSAPLPTPAPSS

SEQ ID NO: 7007 - protein, 13 aa, Mus sp.
NNPWVTPIADQFQ

SEQ ID NO: 7008 - protein, 16 aa, Mus sp.
DDIRSDWTNPEINKAV

SEQ ID NO: 7009 - protein, 16 aa, Mus sp.
DVSAYIPTNVISITDG

SEQ ID NO: 7010 - protein, 16 aa, Mus sp.
QIYYAGPVNNPGLDVP

SEQ ID NO: 7011 - protein, 16 aa, Mus sp.
NLRKMGAPEAGMAEYL

SEQ ID NO: 7012 - protein, 14 aa, Mus sp.
KFDEWVAPTPEVAD

SEQ ID NO: 7013 - protein, 20 aa, Mus sp.
KLYFHGVFRQRIEMLLSAQT

SEQ ID NO: 7014 - protein, 16 aa, Mus sp.
VPNYKLITPAVVSERL

SEQ ID NO: 7015 - protein, 14 aa, Mus sp.
EDYVELPPSVSQAA

SEQ ID NO: 7016 - protein, 17 aa, Mus sp.
KVLPTYDASKVTASGPG

SEQ ID NO: 7017 - protein, 16 aa, Mus sp.
VGETFHASQPSLTVDG

SEQ ID NO: 7018 - protein, 19 aa, Mus sp.
EDDIEADHVGTYGISVYQS

SEQ ID NO: 7019 - protein, 14 aa, Mus sp.
LPPYDDATAVPSTA

SEQ ID NO: 7020 - protein, 16 aa, Mus sp.
TKNLDYVATSIHEAVT

SEQ ID NO: 7021 - protein, 16 aa, Mus sp.
KLLEAKGPVTDVAYSH

SEQ ID NO: 7022 - protein, 19 aa, Mus sp.
APGPSHTVAAPQAAAAAAL

SEQ ID NO: 7023 - protein, 17 aa, Mus sp.
GVPVPGSPFPLEAVAPT

SEQ ID NO: 7024 - protein, 15 aa, Mus sp.
DFVAWATGEPNFAND

SEQ ID NO: 7025 - protein, 13 aa, Mus sp.
GTPDYIAPEILQG

SEQ ID NO: 7026 - protein, 14 aa, Mus sp.
TPDIIINPHAIPSR

SEQ ID NO: 7027 - protein, 17 aa, Mus sp.
KDPFWWNGAEPIWVTNQ

SEQ ID NO: 7028 - protein, 16 aa, Mus sp.
SPVTTASMSGCLSFYY

SEQ ID NO: 7029 - protein, 8 aa, Mus sp.
SVLQFLGL

SEQ ID NO: 7030 - protein, 22 aa, Mus sp.
LPNKPTVTVVSPLPNDSINPQP

SEQ ID NO: 7031 - protein, 19 aa, Mus sp.
SPPGGDFSDPVTSATLGIV

SEQ ID NO: 7032 - protein, 14 aa, Mus sp.
FRVPTPNVSVVDLT

SEQ ID NO: 7033 - protein, 18 aa, Mus sp.
TDKFWGPSGAESVIGGVH

SEQ ID NO: 7034 - protein, 15 aa, Mus sp.
WNHRYGEPIPSTTLT

SEQ ID NO: 7035 - protein, 13 aa, Mus sp.
VNWYAPLVAPISK

SEQ ID NO: 7036 - protein, 17 aa, Mus sp.
EDGELTYENVQVSPVPG

SEQ ID NO: 7037 - protein, 13 aa, Mus sp.
GGYVAPKAVWLPA

SEQ ID NO: 7038 - protein, 17 aa, Mus sp.
YDPDFLRTAVAQVIGDR

SEQ ID NO: 7039 - protein, 15 aa, Mus sp.
LGTEEISPRVLQSLG

SEQ ID NO: 7040 - protein, 15 aa, Mus sp.
PGKTSRLYQTFYLNT

SEQ ID NO: 7041 - protein, 20 aa, Mus sp.
GPNDERFGVRFPAMSDAYDR

SEQ ID NO: 7042 - protein, 15 aa, Mus sp.
VGGERFEAPEALFQP

SEQ ID NO: 7043 - protein, 14 aa, Mus sp.
VSFVQPNGAIFEPS

SEQ ID NO: 7044 - protein, 24 aa, Mus sp.
KPFPWGDGNHTLFHNPHVNPLPTG

SEQ ID NO: 7045 - protein, 13 aa, Mus sp.
NAANVGWNGSTFA

SEQ ID NO: 7046 - protein, 17 aa, Mus sp.
DPSAFAAAAPAAAATTA

SEQ ID NO: 7047 - protein, 16 aa, Mus sp.
EYFVFRPGTIEQAVEE

SEQ ID NO: 7048 - protein, 18 aa, Mus sp.
KPVPAAPVPSPVAPAPVP

SEQ ID NO: 7049 - protein, 17 aa, Mus sp.
VGGERFEAPEALFQPHL

SEQ ID NO: 7050 - protein, 17 aa, Mus sp.
SAPPHFHFGQTNRTPEF

SEQ ID NO: 7051 - protein, 15 aa, Mus sp.
NDLQYAAPGGLIGVG

SEQ ID NO: 7052 - protein, 15 aa, Mus sp.
ASLEDFYGSPIPSVS

SEQ ID NO: 7053 - protein, 21 aa, Mus sp.
APKETTIWVSPSPILEEGSPV

SEQ ID NO: 7054 - protein, 14 aa, Mus sp.
FDNYEGSAPNLYVW

SEQ ID NO: 7055 - protein, 18 aa, Mus sp.
EAPSIFLDPETRQAMGEQ

SEQ ID NO: 7056 - protein, 16 aa, Mus sp.
ETETVFAPVIQAGMEA

SEQ ID NO: 7057 - protein, 13 aa, Mus sp.
SKNVFLSPMSISS

SEQ ID NO: 7058 - protein, 15 aa, Mus sp.
IVDPYNNPVPRGLEA

SEQ ID NO: 7059 - protein, 19 aa, Listeria monocytogenes
DFRYVFDTAKATAASSYPG

SEQ ID NO: 7060 - protein, 18 aa, Mus sp.
GTTVYRQFWIFDVQNPDD

SEQ ID NO: 7061 - protein, 12 aa, Mus sp.
DDIEADHVGTYG

SEQ ID NO: 7062 - protein, 18 aa, Mus sp.
NLRDNYRFAHTNIESLVK

SEQ ID NO: 7063 - protein, 17 aa, Mus sp.
GSTLWSSPLPEEAQDVT

SEQ ID NO: 7064 - protein, 22 aa, Mus sp.
GPDGKGMNPPSYYTQPVPVPNA

SEQ ID NO: 7065 - protein, 12 aa, Mus sp.
NSEFDPPGPNVA

SEQ ID NO: 7066 - protein, 15 aa, Mus sp.
ETVVTPEAAPEKNPV

SEQ ID NO: 7067 - protein, 15 aa, Mus sp.
EWKFTITPPSAQVVG

SEQ ID NO: 7068 - protein, 14 aa, Mus sp.
LDYFKGAIPIRKLV

SEQ ID NO: 7069 - protein, 15 aa, Mus sp.
RLEQPNVVISLSRTE

SEQ ID NO: 7070 - protein, 16 aa, Mus sp.
YVELPPSVSQAAKSPP

SEQ ID NO: 7071 - protein, 15 aa, Mus sp.
SDPRWAESVPQEAPG

SEQ ID NO: 7072 - protein, 13 aa, Mus sp.
VTQFHPPHIEIQM

SEQ ID NO: 7073 - protein, 15 aa, Mus sp.
LPVKWTAPEALREKK

SEQ ID NO: 7074 - protein, 16 aa, Mus sp.
NHIEVWERPLSNLAWA

SEQ ID NO: 7075 - protein, 14 aa, Mus sp.
EEKYHEALAKGDVT

SEQ ID NO: 7076 - protein, 22 aa, Mus sp.
GVEAARDNMFSGSKINYTENRA

SEQ ID NO: 7077 - protein, 16 aa, Mus sp.
QASIYSPPAAAAAAAA

SEQ ID NO: 7078 - protein, 14 aa, Mus sp.
QKQQWITPFTNGDK

SEQ ID NO: 7079 - protein, 22 aa, Mus sp.
GPNIGGDTHFDSAEPWTVQNED

SEQ ID NO: 7080 - protein, 16 aa, Mus sp.
VRIDQYQGADAVGLEE

SEQ ID NO: 7081 - protein, 14 aa, Mus sp.
SPAEYAGPEGSYFG

SEQ ID NO: 7082 - protein, 14 aa, Mus sp.
ISALEYGMPVTLIG

SEQ ID NO: 7083 - protein, 17 aa, Mus sp.
YTWSDAAAPFAGLSTDQ

SEQ ID NO: 7084 - protein, 15 aa, Mus sp.
GVLLPFFDPDTNIVY

SEQ ID NO: 7085 - protein, 16 aa, Listeria monocytogenes
WNEKYAQAYPNVSAKI

SEQ ID NO: 7086 - protein, 16 aa, Mus sp.
VKDGYQMAQPVFAPKN

SEQ ID NO: 7087 - protein, 13 aa, Mus sp.
RYMAPEVLDDSIN

SEQ ID NO: 7088 - protein, 18 aa, Mus sp.
SIPEAQWQSSLARTSSAE

SEQ ID NO: 7089 - protein, 14 aa, Mus sp.
ELVRAPTAALSPEP

SEQ ID NO: 7090 - protein, 12 aa, Mus sp.
GKKFTAPHILIA

SEQ ID NO: 7091 - protein, 15 aa, Mus sp.
GDISISGPKVNVEAP

SEQ ID NO: 7092 - protein, 13 aa, Mus sp.
LPDFHVPEITIPE

SEQ ID NO: 7093 - protein, 14 aa, Mus sp.
AEEYEFLTPMEEAP

SEQ ID NO: 7094 - protein, 16 aa, Mus sp.
TVPIYEGYALPHAILR

SEQ ID NO: 7095 - protein, 16 aa, Mus sp.
TSSYYRGAHGIIVVYD

SEQ ID NO: 7096 - protein, 15 aa, Mus sp.
QYPNFAGPQAALANK

SEQ ID NO: 7097 - protein, 15 aa, Mus sp.
YQMYGGPVVLVAHSM

SEQ ID NO: 7098 - protein, 23 aa, Mus sp.
ADHVGTYGISVYQSPGDIGQYTF

SEQ ID NO: 7099 - protein, 19 aa, Mus sp.
YKKELEEQLGPVAEETRAR

SEQ ID NO: 7100 - protein, 18 aa, Mus sp.
SMRYFETAVSRPGLEEPR

SEQ ID NO: 7101 - protein, 14 aa, Mus sp.
EFDYSGSQAIKALK

SEQ ID NO: 7102 - protein, 15 aa, Mus sp.
EELYMPPLVIKVIDH

SEQ ID NO: 7103 - protein, 22 aa, Mus sp.
VDPTPDPNTAYASYPSASVENY

SEQ ID NO: 7104 - protein, 19 aa, Mus sp.
DGTVPFWAHAGNAIPSADQ

SEQ ID NO: 7105 - protein, 13 aa, Mus sp.
NSVFVAPAVTPVK

SEQ ID NO: 7106 - protein, 15 aa, Mus sp.
MFETFNTPAMYVAIQ

SEQ ID NO: 7107 - protein, 19 aa, Mus sp.
YPRDISNYGFPRSVQAIDA

SEQ ID NO: 7108 - protein, 13 aa, Mus sp.
VRVDEYDYSKPIQ

SEQ ID NO: 7109 - protein, 18 aa, Mus sp.
SSSIASFKDPKISTSLPV

SEQ ID NO: 7110 - protein, 16 aa, Mus sp.
GPVPEFSGATVERVSE

SEQ ID NO: 7111 - protein, 16 aa, Mus sp.
PPSYYTQPVPVPNANA

SEQ ID NO: 7112 - protein, 21 aa, Mus sp.
EPSPVSETVVTPEAAPEKNPV

SEQ ID NO: 7113 - protein, 16 aa, Mus sp.
AQPATAPQAAAAQEPG

SEQ ID NO: 7114 - protein, 20 aa, Mus sp.
GPHSMRYFETAVSRPGLEEP

SEQ ID NO: 7115 - protein, 17 aa, Mus sp.
LPDDINVYATTAANPKE

SEQ ID NO: 7116 - protein, 12 aa, Mus sp.
WKYEKPDGSPVF

SEQ ID NO: 7117 - protein, 14 aa, Mus sp.
LDQLFSGPLPGRLP

SEQ ID NO: 7118 - protein, 17 aa, Mus sp.
GPYQAAAGPSVVPTAPP

SEQ ID NO: 7119 - protein, 15 aa, Mus sp.
GTPFWMAPEVIQEIG

SEQ ID NO: 7120 - protein, 21 aa, Mus sp.
FLYQQQGRLDKLTITSQNLQL

SEQ ID NO: 7121 - protein, 15 aa, Mus sp.
LPDYSAPNPIKVTHR

SEQ ID NO: 7122 - protein, 19 aa, Mus sp.
SPSSPEYTPASPKYSPTSP

SEQ ID NO: 7123 - protein, 15 aa, Mus sp.
FYSKYSAPRLPAALE

SEQ ID NO: 7124 - protein, 16 aa, Mus sp.
GDGIEDFVSGVPRAAR

SEQ ID NO: 7125 - protein, 17 aa, Mus sp.
EDWPTFLNPNVDKAGPA

SEQ ID NO: 7126 - protein, 15 aa, Mus sp.
ADHFEIRFPLALDVK

SEQ ID NO: 7127 - protein, 17 aa, Mus sp.
FKHAVSDPSILDSLDLN

SEQ ID NO: 7128 - protein, 16 aa, Mus sp.
LPENFRRPQTDQAVEF

SEQ ID NO: 7129 - protein, 18 aa, Mus sp.
VLITDKFWGPSGAESVIG

SEQ ID NO: 7130 - protein, 15 aa, Mus sp.
SVFVAPAVTPVKGVL

SEQ ID NO: 7131 - protein, 15 aa, Mus sp.
IPKLVYHKNIPEWDH

SEQ ID NO: 7132 - protein, 17 aa, Mus sp.
INKMDDPTVNWSNERYE

SEQ ID NO: 7133 - protein, 16 aa, Mus sp.
YYNEVHSPSVAVEMGM

SEQ ID NO: 7134 - protein, 13 aa, Mus sp.
VNSQYQEPDIIIH

SEQ ID NO: 7135 - protein, 14 aa, Mus sp.
SVFVAPAVTPVKGV

SEQ ID NO: 7136 - protein, 16 aa, Mus sp.
WKALYTDPKSSETAAF

SEQ ID NO: 7137 - protein, 22 aa, Mus sp.
GPHSMRYFETAVSRPGLEEPRY

SEQ ID NO: 7138 - protein, 15 aa, BOVIN
ASVVVGPSVVAVPLP

SEQ ID NO: 7139 - protein, 14 aa, Mus sp.
VSWQEKQPEASISQ

SEQ ID NO: 7140 - protein, 15 aa, Mus sp.
EVQWQSAEPGSTPRK

SEQ ID NO: 7141 - protein, 17 aa, Mus sp.
LIGRTWNDPSVQQDIKF

SEQ ID NO: 7142 - protein, 14 aa, Mus sp.
TNTAYVGSAILSEE

SEQ ID NO: 7143 - protein, 16 aa, Mus sp.
APDAWDYSQGFVNEEM

SEQ ID NO: 7144 - protein, 14 aa, Mus sp.
NVDPFKAVDTNRAS

SEQ ID NO: 7145 - protein, 18 aa, Mus sp.
TPRVLSQAPSPLYSVEFS

SEQ ID NO: 7146 - protein, 15 aa, Mus sp.
ELVRAPTAALSPEPQ

SEQ ID NO: 7147 - protein, 19 aa, Mus sp.
LPPASLPESTPVPSSSPPP

SEQ ID NO: 7148 - protein, 14 aa, Mus sp.
MAPYQGPDAAPGAL

SEQ ID NO: 7149 - protein, 17 aa, Mus sp.
PTLDHYKEPSAIFQLPY

SEQ ID NO: 7150 - protein, 18 aa, Mus sp.
NPEKHIYSSITTWETTER

SEQ ID NO: 7151 - protein, 12 aa, Mus sp.
LIRNGDWTFQVL

SEQ ID NO: 7152 - protein, 16 aa, Mus sp.
GRPDAEYWNSQPEILE

SEQ ID NO: 7153 - protein, 11 aa, Mus sp.
LSYIGPSVNKA

SEQ ID NO: 7154 - protein, 14 aa, Mus sp.
FGNIYSTPLALQML

SEQ ID NO: 7155 - protein, 15 aa, Mus sp.
NQLEALVGPEANVGP

SEQ ID NO: 7156 - protein, 16 aa, Mus sp.
SIKEKYNSFWIGLSYT

SEQ ID NO: 7157 - protein, 14 aa, Mus sp.
IQEPYTFPAILKSV

SEQ ID NO: 7158 - protein, 16 aa, Mus sp.
DHRGTWNGPWVSTEVL

SEQ ID NO: 7159 - protein, 15 aa, Mus sp.
TEEKYHEALAKGDVT

SEQ ID NO: 7160 - protein, 18 aa, Mus sp.
TPAPTPAATPAASPAPVS

SEQ ID NO: 7161 - protein, 20 aa, Mus sp.
GSNLSINTNQNINIKSEPIS

SEQ ID NO: 7162 - protein, 13 aa, Mus sp.
YEWAPPVQNQALA

SEQ ID NO: 7163 - protein, 24 aa, Mus sp.
KPTVTVVSPLPNDSINPQPSPDGL

SEQ ID NO: 7164 - protein, 18 aa, Mus sp.
DVKKPAAAPAPAPAPAPA

SEQ ID NO: 7165 - protein, 17 aa, Mus sp.
DLGSDIFAAPAPQSTAT

SEQ ID NO: 7166 - protein, 12 aa, Mus sp.
TPFWMAPEVIQE

SEQ ID NO: 7167 - protein, 15 aa, Mus sp.
SRGEYSWAVAQGVKQ

SEQ ID NO: 7168 - protein, 21 aa, Mus sp.
LPGNLDYWTYPGSLTTPPLLE

SEQ ID NO: 7169 - protein, 15 aa, Mus sp.
SALEYGMPVTLIGEA

SEQ ID NO: 7170 - protein, 16 aa, Mus sp.
LRDMYSKSSAAMSTYA

SEQ ID NO: 7171 - protein, 13 aa, Mus sp.
HIEVWERPLSNLA

SEQ ID NO: 7172 - protein, 14 aa, Mus sp.
REGSYEAAKILLDH

SEQ ID NO: 7173 - protein, 17 aa, Mus sp.
IGDSNFGAPSASVAAAP

SEQ ID NO: 7174 - protein, 18 aa, Mus sp.
DGLNLDWQYPGSRGSPPK

SEQ ID NO: 7175 - protein, 16 aa, Mus sp.
AARDNMFSGSKINYTE

SEQ ID NO: 7176 - protein, 16 aa, Mus sp.
EPYAHAAPESIPATFE

SEQ ID NO: 7177 - protein, 15 aa, Mus sp.
DFLKKWETPSQNTAQ

SEQ ID NO: 7178 - protein, 14 aa, Mus sp.
VIYTHPEVAWVGKS

SEQ ID NO: 7179 - protein, 15 aa, Mus sp.
ARDNMFSGSKINYTE

SEQ ID NO: 7180 - protein, 16 aa, Mus sp.
ADPSAFAAAAPAAAAT

SEQ ID NO: 7181 - protein, 22 aa, Mus sp.
TPPPPPPNEISPPHAVEEEEDD

SEQ ID NO: 7182 - protein, 19 aa, Mus sp.
VPDVDISSPGINVEAPDIH

SEQ ID NO: 7183 - protein, 17 aa, Mus sp.
GEQSWIQALPSVAKEEK

SEQ ID NO: 7184 - protein, 18 aa, Mus sp.
QPSTSSLAAPTVEAAASA

SEQ ID NO: 7185 - protein, 20 aa, Mus sp.
EPSPVSETVVTPEAAPEKNP

SEQ ID NO: 7186 - protein, 17 aa, Mus sp.
GALLLNAPVVSITQGRN

SEQ ID NO: 7187 - protein, 15 aa, Mus sp.
ETETVFAPVIQAGME

SEQ ID NO: 7188 - protein, 13 aa, Mus sp.
SDVIHAPLPSPVD

SEQ ID NO: 7189 - protein, 16 aa, Mus sp.
NSEVYHEPHIADAWPQ

SEQ ID NO: 7190 - protein, 21 aa, Mus sp.
LVVSNITRLIDLPGTELAQLM

SEQ ID NO: 7191 - protein, 17 aa, Mus sp.
SDGYPVLYPTGWSSSDN

SEQ ID NO: 7192 - protein, 14 aa, Mus sp.
NPDFTQPISEVVDE

SEQ ID NO: 7193 - protein, 13 aa, Mus sp.
VQNYPVVSIEDPF

SEQ ID NO: 7194 - protein, 15 aa, Mus sp.
LGDVFLGPYVAVFDR

SEQ ID NO: 7195 - protein, 19 aa, Mus sp.
SELERESKVVVPPLPGKAF

SEQ ID NO: 7196 - protein, 15 aa, BOVIN
AVPDAAGPTPSAAGP

SEQ ID NO: 7197 - protein, 25 aa, Mus sp.
ASFDPQGGLQNIAVVKHNLGVLTKR

SEQ ID NO: 7198 - protein, 17 aa, Mus sp.
TPRVLSQAPSPLYSVEF

SEQ ID NO: 7199 - protein, 13 aa, Mus sp.
KFVYAGSNSGVVQ

SEQ ID NO: 7200 - protein, 17 aa, Mus sp.
GTPDYISPEVLKSQGGD

SEQ ID NO: 7201 - protein, 13 aa, Mus sp.
FRVPTPNVSVVDL

SEQ ID NO: 7202 - protein, 17 aa, Mus sp.
EDNVFEAPTLVKVFKQP

SEQ ID NO: 7203 - protein, 15 aa, Mus sp.
GGYKFSAPVVPSSFN

SEQ ID NO: 7204 - protein, 16 aa, Mus sp.
VADLVKNPTASLVLPE

SEQ ID NO: 7205 - protein, 17 aa, Mus sp.
AVKSKYKASIAALEAKI

SEQ ID NO: 7206 - protein, 16 aa, Mus sp.
SALVWLSPSVLVSGAE

SEQ ID NO: 7207 - protein, 17 aa, BOVIN
YQEPVLGPVRGPFPIIV

SEQ ID NO: 7208 - protein, 18 aa, Mus sp.
SREQFSYVLPTVHSLEPS

SEQ ID NO: 7209 - protein, 21 aa, Mus sp.
EPSKLKRSYSSPDITQALQEE

SEQ ID NO: 7210 - protein, 17 aa, Mus sp.
SLEDFYGSPIPSVSLKL

SEQ ID NO: 7211 - protein, 18 aa, Mus sp.
SYPFDFQGAKIITGQEEG

SEQ ID NO: 7212 - protein, 18 aa, Mus sp.
IDTSLKAPDVDVSVAGPD

SEQ ID NO: 7213 - protein, 14 aa, Mus sp.
RSNEFDYPSVGQLA

SEQ ID NO: 7214 - protein, 18 aa, Mus sp.
GGDTHFDSAEPWTVQNED

SEQ ID NO: 7215 - protein, 16 aa, Mus sp.
VADKEFHAPLIIDENG

SEQ ID NO: 7216 - protein, 28 aa, Mus sp.
EKWEETELDQLFSGPLPGRLPVNHRPFS

SEQ ID NO: 7217 - protein, 12 aa, Mus sp.
EFDYSGSQAIKA

SEQ ID NO: 7218 - protein, 16 aa, Mus sp.
HKAFLEVNEEGSEAAA

SEQ ID NO: 7219 - protein, 18 aa, Mus sp.
ESLHLRFSAPQIENEPET

SEQ ID NO: 7220 - protein, 16 aa, Mus sp.
TPESFLGPNAALVDLD

SEQ ID NO: 7221 - protein, 13 aa, Mus sp.
ITWTWQGPGALKI

SEQ ID NO: 7222 - protein, 18 aa, Mus sp.
DDGTVIHFNNPKVQASLS

SEQ ID NO: 7223 - protein, 14 aa, Mus sp.
LSLKYHFVTPLTSM

SEQ ID NO: 7224 - protein, 15 aa, Mus sp.
GDTHFDSAEPWTVQN

SEQ ID NO: 7225 - protein, 15 aa, Mus sp.
QSPYINPIIPFTGPI

SEQ ID NO: 7226 - protein, 13 aa, Mus sp.
LPYDTPVPGYMNN

SEQ ID NO: 7227 - protein, 18 aa, Mus sp.
ELGRPDAEYWNSQPEILE

SEQ ID NO: 7228 - protein, 18 aa, Mus sp.
VGGERFEAPEALFQPHLI

SEQ ID NO: 7229 - protein, 14 aa, Mus sp.
GKWKYEKPDGSPVF

SEQ ID NO: 7230 - protein, 16 aa, Mus sp.
TETQEKNPLPSKETIE

SEQ ID NO: 7231 - protein, 15 aa, Mus sp.
EKPVPAAPVPSPVAP

SEQ ID NO: 7232 - protein, 17 aa, Mus sp.
APAAAEAPAAAEAPAPA

SEQ ID NO: 7233 - protein, 14 aa, Mus sp.
IEQSWGSPKVTKDG

SEQ ID NO: 7234 - protein, 16 aa, Mus sp.
DVVHGFYNPAVSRIVE

SEQ ID NO: 7235 - protein, 15 aa, Mus sp.
ADPSAFAAAAPAAAA

SEQ ID NO: 7236 - protein, 23 aa, Mus sp.
DVDFEGVKKKAGYITPVPGGVGP

SEQ ID NO: 7237 - protein, 15 aa, Mus sp.
NFPLKPGIPLPSPED

SEQ ID NO: 7238 - protein, 17 aa, Mus sp.
SSSIASFKDPKISTSLP

SEQ ID NO: 7239 - protein, 14 aa, Mus sp.
LPAAAQAPDALPAG

SEQ ID NO: 7240 - protein, 9 aa, Mus sp.
GRDFYKILG

SEQ ID NO: 7241 - protein, 14 aa, Mus sp.
VNWYAPLVAPISKD

SEQ ID NO: 7242 - protein, 14 aa, Mus sp.
VATENGYSYPVVSY

SEQ ID NO: 7243 - protein, 14 aa, Mus sp.
VIHFNNPKVQASLA

SEQ ID NO: 7244 - protein, 11 aa, Mus sp.
RVPTPNVSVVD

SEQ ID NO: 7245 - protein, 16 aa, Mus sp.
IPQAERYQEALPTVAN

SEQ ID NO: 7246 - protein, 12 aa, Mus sp.
EDFYGSPIPSVS

SEQ ID NO: 7247 - protein, 15 aa, Mus sp.
DDDVYRAPPIDRSIL

SEQ ID NO: 7248 - protein, 16 aa, Mus sp.
KEVDRYDAPGIAFYPG

SEQ ID NO: 7249 - protein, 16 aa, Mus sp.
MRPFYQGPVGDPATYR

SEQ ID NO: 7250 - protein, 15 aa, Mus sp.
AVNWYAPLVAPISKD

SEQ ID NO: 7251 - protein, 12 aa, Mus sp.
EEAESFADMMKH

SEQ ID NO: 7252 - protein, 17 aa, Mus sp.
ITDKFWGPSGAESVIGG

SEQ ID NO: 7253 - protein, 10 aa, Mus sp.
FGIHNGVETL

SEQ ID NO: 7254 - protein, 12 aa, Mus sp.
FGPYYTEPVIAG

SEQ ID NO: 7255 - protein, 22 aa, Mus sp.
APETRSQVTPSVPSEALDDSTG

SEQ ID NO: 7256 - protein, 16 aa, Mus sp.
GKWKYEKPDGSPVFIA

SEQ ID NO: 7257 - protein, 18 aa, Mus sp.
GDLERFLSSAAAVSKEHP

SEQ ID NO: 7258 - protein, 14 aa, Mus sp.
RTWNDPSVQQDIKF

SEQ ID NO: 7259 - protein, 14 aa, Mus sp.
ASVGAWTGPMGNWA

SEQ ID NO: 7260 - protein, 15 aa, Mus sp.
FATGFSHPLTQSAVM

SEQ ID NO: 7261 - protein, 16 aa, Mus sp.
SPKVTYKAPVPTGEVY

SEQ ID NO: 7262 - protein, 14 aa, Mus sp.
HPIQWNAPEPSHIT

SEQ ID NO: 7263 - protein, 14 aa, Mus sp.
ANPDFTQPISEVVD

SEQ ID NO: 7264 - protein, 20 aa, Mus sp.
DKSYIEGYVPSQADVAVFEA

SEQ ID NO: 7265 - protein, 15 aa, Mus sp.
LVQTYVGAISNGSLP

SEQ ID NO: 7266 - protein, 23 aa, Mus sp.
GPPGFEDYVELPPSVSQAATSPP

SEQ ID NO: 7267 - protein, 20 aa, Mus sp.
EGPEVDVSLPKANIDVSGPK

SEQ ID NO: 7268 - protein, 21 aa, Mus sp.
KPTVTVVSPLPNDSINPQPSP

SEQ ID NO: 7269 - protein, 17 aa, Mus sp.
LPQDPTFHTPLDLYAYA

SEQ ID NO: 7270 - protein, 23 aa, Mus sp.
EPGLFEWTKWVAGSTLPAWIPPS

SEQ ID NO: 7271 - protein, 15 aa, Mus sp.
TGVDFIGSTVGLAKV

SEQ ID NO: 7272 - protein, 18 aa, Mus sp.
LAPMYYRGAQAAIVVYDI

SEQ ID NO: 7273 - protein, 17 aa, Mus sp.
APNLHFHNPNPEIPALL

SEQ ID NO: 7274 - protein, 18 aa, Mus sp.
KGPAFVNPLIPENKEEEE

SEQ ID NO: 7275 - protein, 20 aa, Mus sp.
ITVKELFTTPVLRASVSSPF

SEQ ID NO: 7276 - protein, 15 aa, Mus sp.
KFRFEEPVVLPDLSD

SEQ ID NO: 7277 - protein, 15 aa, Mus sp.
VSVEFIAPTLEGTYT

SEQ ID NO: 7278 - protein, 13 aa, Mus sp.
TTDYNSPEAGNIF

SEQ ID NO: 7279 - protein, 16 aa, Mus sp.
DITHTYKYPEGSPEER

SEQ ID NO: 7280 - protein, 15 aa, Mus sp.
DNYLTSPLPEEVDET

SEQ ID NO: 7281 - protein, 17 aa, Mus sp.
GPRPEEYEFLTPVEEAP

SEQ ID NO: 7282 - protein, 10 aa, BOVIN
VVPPFLQPEV

SEQ ID NO: 7283 - protein, 8 aa, BOVIN
VYPFPGPI

SEQ ID NO: 7284 - protein, 23 aa, Listeria monocytogenes
AVDDTTVKFTLPTVAPAFENTIK

SEQ ID NO: 7285 - protein, 18 aa, Listeria monocytogenes
GTKEKVVATPVSNVSTSS

SEQ ID NO: 7286 - protein, 19 aa, Listeria monocytogenes
GTKEKVVATPVSNVSTSSA

SEQ ID NO: 7287 - protein, 18 aa, Listeria monocytogenes
MNRVMLPLQQMGAKMHGK

SEQ ID NO: 7288 - protein, 25 aa, Listeria monocytogenes
DFRYVFDTAKATAASSYPGSDETPP

SEQ ID NO: 7289 - protein, 12 aa, Mus sp.
IEVSSPITLQAL

SEQ ID NO: 7290 - protein, 16 aa, Mus sp.
PNENCLKQIAVSSVPS

SEQ ID NO: 7291 - protein, 18 aa, Mus sp.
YPTPAYTIPFYTPIPNGL

SEQ ID NO: 7292 - protein, 21 aa, Mus sp.
YPTPAYTIPFYTPIPNGLYPS

SEQ ID NO: 7293 - protein, 17 aa, Mus sp.
TWSDAAAPFAGLSTDQT

SEQ ID NO: 7294 - protein, 18 aa, Mus sp.
TWSDAAAPFAGLSTDQTL

SEQ ID NO: 7295 - protein, 16 aa, Mus sp.
WSDAAAPFAGLSTDQT

SEQ ID NO: 7296 - protein, 18 aa, Mus sp.
YTWSDAAAPFAGLSTDQT

SEQ ID NO: 7297 - protein, 18 aa, Mus sp.
DPSKTGIGAPTISTGPPG

SEQ ID NO: 7298 - protein, 17 aa, Mus sp.
AQRAGYKAAIVHNVDSD

SEQ ID NO: 7299 - protein, 22 aa, Mus sp.
DPTPDPNTAYASYPSASVENYQ

SEQ ID NO: 7300 - protein, 25 aa, Mus sp.
DPTPDPNTAYASYPSASVENYQQPP

SEQ ID NO: 7301 - protein, 20 aa, Mus sp.
VDPTPDPNTAYASYPSASVE

SEQ ID NO: 7302 - protein, 21 aa, Mus sp.
VDPTPDPNTAYASYPSASVEN

SEQ ID NO: 7303 - protein, 23 aa, Mus sp.
VDPTPDPNTAYASYPSASVENYQ

SEQ ID NO: 7304 - protein, 11 aa, Mus sp.
VPWSPPQSNWN

SEQ ID NO: 7305 - protein, 15 aa, Mus sp.
DISNYGFPRSVQAID

SEQ ID NO: 7306 - protein, 16 aa, Mus sp.
DISNYGFPRSVQAIDA

SEQ ID NO: 7307 - protein, 17 aa, Mus sp.
DISNYGFPRSVQAIDAA

SEQ ID NO: 7308 - protein, 14 aa, Mus sp.
RERYNFPNPNPFVE

SEQ ID NO: 7309 - protein, 14 aa, Mus sp.
DIRSDWTNPEINKA

SEQ ID NO: 7310 - protein, 16 aa, Mus sp.
ITNQYNSPTGLYSSEN

SEQ ID NO: 7311 - protein, 19 aa, Mus sp.
GEQIYYAGPVNNPGLDVPQ

SEQ ID NO: 7312 - protein, 19 aa, Mus sp.
WGIDPYDQPNAIYIERHEP

SEQ ID NO: 7313 - protein, 21 aa, Mus sp.
WGIDPYDQPNAIYIERHEPFG

SEQ ID NO: 7314 - protein, 15 aa, Mus sp.
YVTQFHPPHIEIQML

SEQ ID NO: 7315 - protein, 16 aa, Mus sp.
YVTQFHPPHIEIQMLK

SEQ ID NO: 7316 - protein, 15 aa, Mus sp.
NLDYVATSIHEAVTK

SEQ ID NO: 7317 - protein, 19 aa, Mus sp.
LQHGSLFLKTPKIVSSKDY

SEQ ID NO: 7318 - protein, 16 aa, Mus sp.
RDNMFSGSKINYTENR

SEQ ID NO: 7319 - protein, 17 aa, Mus sp.
ASVATNPIITPVAQENQ

SEQ ID NO: 7320 - protein, 16 aa, Mus sp.
ELEEQLGPVAEETRAR

SEQ ID NO: 7321 - protein, 19 aa, Mus sp.
IQASVATNPIITPVAQENQ

SEQ ID NO: 7322 - protein, 17 aa, Mus sp.
KKELEEQLGPVAEETRA

SEQ ID NO: 7323 - protein, 13 aa, Mus sp.
LEEQLGPVAEETR

SEQ ID NO: 7324 - protein, 12 aa, Mus sp.
NPIITPVAQENQ

SEQ ID NO: 7325 - protein, 15 aa, Mus sp.
VATNPIITPVAQENQ

SEQ ID NO: 7326 - protein, 20 aa, Mus sp.
SPTSPNYTPTSPNYSPTSPS

SEQ ID NO: 7327 - protein, 17 aa, Mus sp.
SPTSPSYSPTSPNYSPT

SEQ ID NO: 7328 - protein, 20 aa, Mus sp.
SPTSPSYSPTSPSYSPTSPS

SEQ ID NO: 7329 - protein, 17 aa, Mus sp.
TPSSPSYSPSSPSYSPT

SEQ ID NO: 7330 - protein, 15 aa, Mus sp.
TSPSYSPTSPNYSPT

SEQ ID NO: 7331 - protein, 18 aa, Mus sp.
AGPNFEYAEAPSRLSPDD

SEQ ID NO: 7332 - protein, 25 aa, Mus sp.
ITGLDPAGPNFEYAEAPSRLSPDDA

SEQ ID NO: 7333 - protein, 21 aa, Mus sp.
LDPAGPNFEYAEAPSRLSPDD

SEQ ID NO: 7334 - protein, 22 aa, Mus sp.
LDPAGPNFEYAEAPSRLSPDDA

SEQ ID NO: 7335 - protein, 17 aa, Mus sp.
AGNFYVPAEPKLAFVIR

SEQ ID NO: 7336 - protein, 13 aa, Mus sp.
QLIRNGDWTFQVL

SEQ ID NO: 7337 - protein, 12 aa, Mus sp.
QPNVVISLSRTE

SEQ ID NO: 7338 - protein, 15 aa, Mus sp.
RPDAEYWNSQPEILE

SEQ ID NO: 7339 - protein, 9 aa, Mus sp.
SPITVEWRA

SEQ ID NO: 7340 - protein, 15 aa, Mus sp.
STQLIRNGDWTFQVL

SEQ ID NO: 7341 - protein, 25 aa, Mus sp.
IPELNGKLTGMAFRVPTPNVSVVDL

SEQ ID NO: 7342 - protein, 25 aa, Mus sp.
VIPELNGKLTGMAFRVPTPNVSVVD

SEQ ID NO: 7343 - protein, 27 aa, Mus sp.
GNPTVEVDLYTAKGLFRAAVPSGASTG

SEQ ID NO: 7344 - protein, 21 aa, Mus sp.
VDLYTAKGLFRAAVPSGASTG

SEQ ID NO: 7345 - protein, 17 aa, Mus sp.
SNLSYREPDPEDAVGGS

SEQ ID NO: 7346 - protein, 17 aa, Mus sp.
DGELTYENVQVSPVPGG

SEQ ID NO: 7347 - protein, 20 aa, Mus sp.
DGELTYENVQVSPVPGGPPG

SEQ ID NO: 7348 - protein, 21 aa, Mus sp.
EDGELTYENVQVSPVPGGPPG

SEQ ID NO: 7349 - protein, 19 aa, Mus sp.
GELTYENVQVSPVPGGPPG

SEQ ID NO: 7350 - protein, 15 aa, Mus sp.
GPVPWLGPQTDEAIK

SEQ ID NO: 7351 - protein, 14 aa, Mus sp.
VPWNFHEPQPGQYE

SEQ ID NO: 7352 - protein, 15 aa, Mus sp.
VPWNFHEPQPGQYEF

SEQ ID NO: 7353 - protein, 17 aa, Mus sp.
ITVKELFTTPVLRASVS

SEQ ID NO: 7354 - protein, 24 aa, Mus sp.
GPPGFEDYVELPPSVSQAATSPPG

SEQ ID NO: 7355 - protein, 24 aa, Mus sp.
GPPGFEDYVELPPSVSQAAKSPPG

SEQ ID NO: 7356 - protein, 18 aa, Mus sp.
DGEEAGAYDGPRTADGIV

SEQ ID NO: 7357 - protein, 16 aa, Mus sp.
NLRDNYRFAHTNIESL

SEQ ID NO: 7358 - protein, 20 aa, Mus sp.
EKEDRRYNPPIIHQGFQDTS

SEQ ID NO: 7359 - protein, 16 aa, Mus sp.
KEDRRYNPPIIHQGFQ

SEQ ID NO: 7360 - protein, 17 aa, Mus sp.
KEDRRYNPPIIHQGFQD

SEQ ID NO: 7361 - protein, 18 aa, Mus sp.
KEDRRYNPPIIHQGFQDT

SEQ ID NO: 7362 - protein, 16 aa, Mus sp.
GQLPDYTSPVVLPYSR

SEQ ID NO: 7363 - protein, 19 aa, Mus sp.
GDFYPFDGPSGLLAHAFPP

SEQ ID NO: 7364 - protein, 15 aa, Mus sp.
YEDKVYWTDVINEAI

SEQ ID NO: 7365 - protein, 17 aa, Mus sp.
GPKPFSAPKPQTSPSPK

SEQ ID NO: 7366 - protein, 18 aa, Mus sp.
GPKPFSAPKPQTSPSPKP

SEQ ID NO: 7367 - protein, 17 aa, Mus sp.
DGNHTLFHNPHVNPLPT

SEQ ID NO: 7368 - protein, 13 aa, Mus sp.
HTLFHNPHVNPLP

SEQ ID NO: 7369 - protein, 14 aa, Mus sp.
HTLFHNPHVNPLPT

SEQ ID NO: 7370 - protein, 14 aa, Mus sp.
NHTLFHNPHVNPLP

SEQ ID NO: 7371 - protein, 17 aa, Mus sp.
EYPDSWSTPHSYFSLKF

SEQ ID NO: 7372 - protein, 15 aa, Mus sp.
DGDSYRSPWSNKYDP

SEQ ID NO: 7373 - protein, 16 aa, Mus sp.
NIPYFETSAKEAINVE

SEQ ID NO: 7374 - protein, 19 aa, Mus sp.
IGGDTHFDSAEPWTVQNED

SEQ ID NO: 7375 - protein, 8 aa, Mus sp.
INFDFPKL

SEQ ID NO: 7376 - protein, 16 aa, Mus sp.
DGIHHWTPPKGHVDPG

SEQ ID NO: 7377 - protein, 17 aa, Mus sp.
ISKQEYDESGPSIVHRK

SEQ ID NO: 7378 - protein, 14 aa, Mus sp.
GERFEAPEALFQPH

SEQ ID NO: 7379 - protein, 12 aa, Mus sp.
DIFIGPKAEEHR

SEQ ID NO: 7380 - protein, 15 aa, Mus sp.
NVTELNEPLSNEERN

SEQ ID NO: 7381 - protein, 8 aa, Mus sp.
VNFEFPEF

SEQ ID NO: 7382 - protein, 21 aa, Mus sp.
LVTYVPVTTFKNLQTVNVDEN

SEQ ID NO: 7383 - protein, 12 aa, Mus sp.
VTYVPVTTFKNL

SEQ ID NO: 7384 - protein, 20 aa, Mus sp.
VTYVPVTTFKNLQTVNVDEN

SEQ ID NO: 7385 - protein, 9 aa, Mus sp.
LDFGSLSNL

SEQ ID NO: 7386 - protein, 16 aa, Mus sp.
VGINYQPPTVVPGGDL

SEQ ID NO: 7387 - protein, 19 aa, Mus sp.
NPLNSVFVAPAVTPVKGVL

SEQ ID NO: 7388 - protein, 16 aa, Mus sp.
IPPTHYAASRAASVAE

SEQ ID NO: 7389 - protein, 19 aa, Mus sp.
YPSQASIYSPPAAAAAAAA

SEQ ID NO: 7390 - protein, 19 aa, Mus sp.
EKPVPAAPVPSPVAPAPVP

SEQ ID NO: 7391 - protein, 16 aa, Mus sp.
LTTSSYSNPTIGYENR

SEQ ID NO: 7392 - protein, 14 aa, Mus sp.
TSSYSNPTIGYENR

SEQ ID NO: 7393 - protein, 15 aa, Mus sp.
TSSYSNPTIGYENRV

SEQ ID NO: 7394 - protein, 15 aa, Mus sp.
TTSSYSNPTIGYENR

SEQ ID NO: 7395 - protein, 16 aa, Mus sp.
TTSSYSNPTIGYENRV

SEQ ID NO: 7396 - protein, 15 aa, Mus sp.
LPANAFASPLQNPDN

SEQ ID NO: 7397 - protein, 17 aa, Mus sp.
KYQNVSGFSNVNINRHS

SEQ ID NO: 7398 - protein, 14 aa, Mus sp.
APDTRFVAPGALGN

SEQ ID NO: 7399 - protein, 13 aa, Mus sp.
SVSYLRECAKAND

SEQ ID NO: 7400 - protein, 18 aa, Mus sp.
HNNILVSSMLESPINSLY

SEQ ID NO: 7401 - protein, 16 aa, Mus sp.
AAELQTLAPAINWLPF

SEQ ID NO: 7402 - protein, 16 aa, Mus sp.
RTDWEAPTGQPSAPGP

SEQ ID NO: 7403 - protein, 17 aa, Mus sp.
SLHLRFSAPQIENEPET

SEQ ID NO: 7404 - protein, 14 aa, Mus sp.
SSIASFKDPKISTS

SEQ ID NO: 7405 - protein, 18 aa, Mus sp.
SSIASFKDPKISTSLPVL

SEQ ID NO: 7406 - protein, 19 aa, Mus sp.
SSIASFKDPKISTSLPVLD

SEQ ID NO: 7407 - protein, 19 aa, Mus sp.
DYLNSDGSAKSSCVSKDVP

SEQ ID NO: 7408 - protein, 14 aa, Mus sp.
RQNFTEPTAIQAQG

SEQ ID NO: 7409 - protein, 16 aa, Mus sp.
DFVAWATGEPNFANDD

SEQ ID NO: 7410 - protein, 17 aa, Mus sp.
DFVAWATGEPNFANDDE

SEQ ID NO: 7411 - protein, 18 aa, Mus sp.
DFVAWATGEPNFANDDEN

SEQ ID NO: 7412 - protein, 15 aa, Mus sp.
TARYMAPEVLESRMN

SEQ ID NO: 7413 - protein, 15 aa, Mus sp.
TVIHFNNPKVQASLA

SEQ ID NO: 7414 - protein, 8 aa, Mus sp.
SSFVFLNL

SEQ ID NO: 7415 - protein, 12 aa, Mus sp.
VFFPPEAQNDFP

SEQ ID NO: 7416 - protein, 16 aa, Mus sp.
GCKVRDHMVVLHDQGE

SEQ ID NO: 7417 - protein, 15 aa, Mus sp.
KDSFSDPYAHVSFLH

SEQ ID NO: 7418 - protein, 18 aa, Mus sp.
HPPQEATNSPKPQPSYEE

SEQ ID NO: 7419 - protein, 17 aa, Mus sp.
AINDYKGAVIVVSHDAR

SEQ ID NO: 7420 - protein, 16 aa, Mus sp.
APISSHTAPRPNPTPA

SEQ ID NO: 7421 - protein, 16 aa, Mus sp.
EAIETIVAAMSNLVPP

SEQ ID NO: 7422 - protein, 19 aa, Mus sp.
KGMKAFVSFVQAYAKHECS

SEQ ID NO: 7423 - protein, 13 aa, Mus sp.
DYVPPTANLDQKD

SEQ ID NO: 7424 - protein, 15 aa, Mus sp.
RDYVPPTANLDQKDK

SEQ ID NO: 7425 - protein, 20 aa, Mus sp.
MIPVWPFPYLSVGTMLKNLN

SEQ ID NO: 7426 - protein, 26 aa, Mus sp.
TPARAPETRSQVTPSVPSEALDDSTG

SEQ ID NO: 7427 - protein, 18 aa, Mus sp.
TRSQVTPSVPSEALDDST

SEQ ID NO: 7428 - protein, 17 aa, Mus sp.
DSKLHHGHDPRGGLQPS

SEQ ID NO: 7429 - protein, 9 aa, Mus sp.
YMIDNIILL

SEQ ID NO: 7430 - protein, 17 aa, Mus sp.
DEGERYIAPTVLVDVQE

SEQ ID NO: 7431 - protein, 14 aa, Mus sp.
NERFRCPEAIFQPS

SEQ ID NO: 7432 - protein, 16 aa, Mus sp.
QIPKVVKSPSSLPAKP

SEQ ID NO: 7433 - protein, 17 aa, Mus sp.
VQIPKVVKSPSSLPAKP

SEQ ID NO: 7434 - protein, 16 aa, Mus sp.
DDLFVEEPKTNDVKDS

SEQ ID NO: 7435 - protein, 14 aa, Mus sp.
DIDSFVPSKAAPAA

SEQ ID NO: 7436 - protein, 14 aa, Mus sp.
FDIFYTAPQPGKYV

SEQ ID NO: 7437 - protein, 13 aa, Mus sp.
VSSVEAPSVSPAR

SEQ ID NO: 7438 - protein, 16 aa, Mus sp.
NTAQYKCPVAMEEADD

SEQ ID NO: 7439 - protein, 17 aa, Mus sp.
GGLPDYSAPNPIKVTHR

SEQ ID NO: 7440 - protein, 15 aa, Mus sp.
GLPDYSAPNPIKVTH

SEQ ID NO: 7441 - protein, 16 aa, Mus sp.
GLPDYSAPNPIKVTHR

SEQ ID NO: 7442 - protein, 16 aa, Mus sp.
EVAQLISPVTTASMSG

SEQ ID NO: 7443 - protein, 20 aa, Mus sp.
FPKPPSYNVATTLPSYDEAE

SEQ ID NO: 7444 - protein, 18 aa, Mus sp.
DWQGGVYASPSIAGSRPG

SEQ ID NO: 7445 - protein, 16 aa, Mus sp.
KTPEIVAPESAHAAFD

SEQ ID NO: 7446 - protein, 17 aa, Mus sp.
WQGGVYASPSIAGSRPG

SEQ ID NO: 7447 - protein, 16 aa, Mus sp.
IMLLYNGPKVNLVIIK

SEQ ID NO: 7448 - protein, 18 aa, Mus sp.
SWKTFLKYSEEVLAVFKS

SEQ ID NO: 7449 - protein, 18 aa, Mus sp.
ADRFMDDIACMIGYRPCP

SEQ ID NO: 7450 - protein, 9 aa, Mus sp.
NVEIDPEIQ

SEQ ID NO: 7451 - protein, 18 aa, Mus sp.
SPALVSYASSLPAQVGTI

SEQ ID NO: 7452 - protein, 13 aa, Mus sp.
IVYEGPELNHAFG

SEQ ID NO: 7453 - protein, 14 aa, Mus sp.
KIVYEGPELNHAFG

SEQ ID NO: 7454 - protein, 17 aa, Mus sp.
VNKGFYKEATQLWGKAE

SEQ ID NO: 7455 - protein, 15 aa, Mus sp.
KERASFITPVPGGVG

SEQ ID NO: 7456 - protein, 16 aa, Mus sp.
VPTVPLLPPQVNQSLA

SEQ ID NO: 7457 - protein, 13 aa, Mus sp.
IILENYAYPGVLL

SEQ ID NO: 7458 - protein, 17 aa, Mus sp.
LAPMYYRGAQAAIVVYD

SEQ ID NO: 7459 - protein, 19 aa, Mus sp.
LAPMYYRGAQAAIVVYDIT

SEQ ID NO: 7460 - protein, 15 aa, Mus sp.
TVIHFNNPKVQASLS

SEQ ID NO: 7461 - protein, 13 aa, Mus sp.
VIHFNNPKVQASL

SEQ ID NO: 7462 - protein, 15 aa, Mus sp.
GGSPYIAAKINEAKD

SEQ ID NO: 7463 - protein, 16 aa, Mus sp.
GGSPYIAAKINEAKDL

SEQ ID NO: 7464 - protein, 14 aa, Mus sp.
GSPYIAAKINEAKD

SEQ ID NO: 7465 - protein, 15 aa, Mus sp.
GSPYIAAKINEAKDL

SEQ ID NO: 7466 - protein, 18 aa, Mus sp.
VPDFSDYRRAEVLDSTKS

SEQ ID NO: 7467 - protein, 17 aa, Mus sp.
RPVQFPYVTPAPHEPVK

SEQ ID NO: 7468 - protein, 16 aa, Mus sp.
FDQGYEAPGVREAAAA

SEQ ID NO: 7469 - protein, 18 aa, Mus sp.
GPGGKWMIPPEAKESMDK

SEQ ID NO: 7470 - protein, 16 aa, Mus sp.
GPPPYHESLAGASQPP

SEQ ID NO: 7471 - protein, 19 aa, Mus sp.
QPTGPPPYHESLAGASQPP

SEQ ID NO: 7472 - protein, 15 aa, Mus sp.
EVLDYSTPTTNGTPE

SEQ ID NO: 7473 - protein, 16 aa, Mus sp.
DTIEFRGPNGLLVYQG

SEQ ID NO: 7474 - protein, 21 aa, Mus sp.
IGYREYSTGGNFQFNIISIDT

SEQ ID NO: 7475 - protein, 16 aa, Mus sp.
TPRDYYFALAHTVRDH

SEQ ID NO: 7476 - protein, 16 aa, Mus sp.
YYLPYKSPGINVDSSY

SEQ ID NO: 7477 - protein, 19 aa, Mus sp.
GLDIYVWRGAQATLSNTTK

SEQ ID NO: 7478 - protein, 8 aa, Mus sp.
AVYAFLGL

SEQ ID NO: 7479 - protein, 16 aa, Mus sp.
LPEYANAEIVRTRDPE

SEQ ID NO: 7480 - protein, 15 aa, Mus sp.
PPSYYTQPVPVPNAN

SEQ ID NO: 7481 - protein, 8 aa, Mus sp.
SVYSFLFL

SEQ ID NO: 7482 - protein, 17 aa, Mus sp.
KGQDHVDFSQPEPHTVL

SEQ ID NO: 7483 - protein, 15 aa, Mus sp.
LEMYKVHNPVPLIVG

SEQ ID NO: 7484 - protein, 17 aa, Mus sp.
GYAVYETPTAHNGAKNP

SEQ ID NO: 7485 - protein, 14 aa, Mus sp.
IPTYTKPNPNQIIS

SEQ ID NO: 7486 - protein, 15 aa, Mus sp.
YIPTYTKPNPNQIIS

SEQ ID NO: 7487 - protein, 14 aa, Mus sp.
RGTSYQSPHGIPID

SEQ ID NO: 7488 - protein, 8 aa, Mus sp.
SNYVFVFL

SEQ ID NO: 7489 - protein, 14 aa, Mus sp.
GNSEFDPPGPNVAT

SEQ ID NO: 7490 - protein, 16 aa, Mus sp.
GNSEFDPPGPNVATTT

SEQ ID NO: 7491 - protein, 13 aa, Mus sp.
NSEFDPPGPNVAT

SEQ ID NO: 7492 - protein, 15 aa, Mus sp.
NSEFDPPGPNVATTT

SEQ ID NO: 7493 - protein, 23 aa, Listeria monocytogenes
VETKADIDALSLLSDKIFVTNQT

SEQ ID NO: 7494 - protein, 18 aa, Mus sp.
GPKPFSAPKPQTSPSPKP

SEQ ID NO: 7495 - protein, 16 aa, Mus sp.
THDLYIQSHISENREE

SEQ ID NO: 7496 - protein, 19 aa, Mus sp.
MTFCKSNVINHFYCADPPL

SEQ ID NO: 7497 - protein, 17 aa, Mus sp.
DISNYGFPRSVQAIDAA

SEQ ID NO: 7498 - protein, 16 aa, Mus sp.
APVEGASPTSISAVDG

SEQ ID NO: 7499 - protein, 14 aa, Mus sp.
DHVDFSQPEPHTVL

SEQ ID NO: 7500 - protein, 12 aa, Mus sp.
IPFYTPIPNGLY

SEQ ID NO: 7501 - protein, 14 aa, Mus sp.
RPDAEYWNSQPEIL

SEQ ID NO: 7502 - protein, 18 aa, Mus sp.
DFVAWATGEPNFANDDEN

SEQ ID NO: 7503 - protein, 16 aa, Mus sp.
GPKPFSAPKPQTSPSP

SEQ ID NO: 7504 - protein, 6 aa, Mus sp.
LVEKIF

SEQ ID NO: 7505 - protein, 13 aa, Mus sp.
GFVLLGATANEVR

SEQ ID NO: 7506 - protein, 20 aa, Mus sp.
SPTSPSYSPTSPNYSPTSPS

SEQ ID NO: 7507 - protein, 17 aa, Mus sp.
GPKPFSAPKPQTSPSPK

SEQ ID NO: 7508 - protein, 18 aa, Mus sp.
HNNILVSSMLESPINSLY

SEQ ID NO: 7509 - protein, 17 aa, Mus sp.
DFVAWATGEPNFANDDE

SEQ ID NO: 7510 - protein, 14 aa, Mus sp.
DRRYNPPIIHQGFQ

SEQ ID NO: 7511 - protein, 15 aa, Mus sp.
LTPWLAPIVSEGTFD

SEQ ID NO: 7512 - protein, 16 aa, Mus sp.
DISNYGFPRSVQAIDA

SEQ ID NO: 7513 - protein, 17 aa, Mus sp.
ISALEYGMPVTLIGEAV

SEQ ID NO: 7514 - protein, 16 aa, Mus sp.
LRDNYRFAHTNIESLV

SEQ ID NO: 7515 - protein, 13 aa, Mus sp.
IVYEGPELNHAFG

SEQ ID NO: 7516 - protein, 15 aa, Mus sp.
YVTQFHPPHIEIQML

SEQ ID NO: 7517 - protein, 15 aa, Mus sp.
NRPAFMPSEGRMVSD

SEQ ID NO: 7518 - protein, 16 aa, Mus sp.
FQHPYNTLKYPNGEGG

SEQ ID NO: 7519 - protein, 20 aa, Mus sp.
DLYKSFVQNYPVVSIEDPFD

SEQ ID NO: 7520 - protein, 14 aa, Mus sp.
SKNVFLSPMSISSA

SEQ ID NO: 7521 - protein, 18 aa, Mus sp.
GPGGKWMIPPEAKESMDK

SEQ ID NO: 7522 - protein, 16 aa, Mus sp.
LTPWLAPIVSEGTFDP

SEQ ID NO: 7523 - protein, 20 aa, Mus sp.
SGPKPFSAPKPQTSPSPKPA

SEQ ID NO: 7524 - protein, 17 aa, Mus sp.
RDLKWGTPVPLEGFEDK

SEQ ID NO: 7525 - protein, 16 aa, Mus sp.
TTSSYSNPTIGYENRV

SEQ ID NO: 7526 - protein, 20 aa, Mus sp.
FYVDLDKKETVWMLPEFGQL

SEQ ID NO: 7527 - protein, 17 aa, Mus sp.
LTPWLAPIVSEGTFDPE

SEQ ID NO: 7528 - protein, 9 aa, Mus sp.
FLLFPDMDA

SEQ ID NO: 7529 - protein, 16 aa, Mus sp.
DFVAWATGEPNFANDD

SEQ ID NO: 7530 - protein, 18 aa, Mus sp.
KHWGEWSPAHPLEAEDTR

SEQ ID NO: 7531 - protein, 15 aa, Mus sp.
YIPTYTKPNPNQIIS

SEQ ID NO: 7532 - protein, 16 aa, Mus sp.
LPEYANAEIVRTRDPE

SEQ ID NO: 7533 - protein, 15 aa, Mus sp.
TSSYSNPTIGYENRV

SEQ ID NO: 7534 - protein, 19 aa, Mus sp.
APQGSLGEYLFERLTLKHD

SEQ ID NO: 7535 - protein, 15 aa, Mus sp.
NLKHVAGAAAAGAVV

SEQ ID NO: 7536 - protein, 17 aa, Mus sp.
IILENYAYPGVLLIGTD

SEQ ID NO: 7537 - protein, 17 aa, Mus sp.
DEGERYIAPTVLVDVQE

SEQ ID NO: 7538 - protein, 19 aa, Mus sp.
SGPKPFSAPKPQTSPSPKP

SEQ ID NO: 7539 - protein, 15 aa, Mus sp.
SPTGNIFFSPFSISS

SEQ ID NO: 7540 - protein, 14 aa, Mus sp.
RKIVYEGPELNHAF

SEQ ID NO: 7541 - protein, 15 aa, Mus sp.
APISSHTAPRPNPTP

SEQ ID NO: 7542 - protein, 15 aa, Mus sp.
GYKPFQNPVPNQSPS

SEQ ID NO: 7543 - protein, 17 aa, BOVIN
PPVASVVVGPSVVAVPL

SEQ ID NO: 7544 - protein, 14 aa, Mus sp.
IPDYWDPAALPDLG

SEQ ID NO: 7545 - protein, 13 aa, Mus sp.
DNIFLSPLSISTA

SEQ ID NO: 7546 - protein, 26 aa, Mus sp.
IPISKVKDVYVITDQIPVFVTMSQKN

SEQ ID NO: 7547 - protein, 25 aa, Mus sp.
NVDPFKAVDTNRASMGQASPESKGF

SEQ ID NO: 7548 - protein, 14 aa, Mus sp.
AGGHKLGLALELEA

SEQ ID NO: 7549 - protein, 18 aa, Mus sp.
YVPPPFAAAAINEAIDAE

SEQ ID NO: 7550 - protein, 14 aa, Mus sp.
GDLAIYAAAVPVSL

SEQ ID NO: 7551 - protein, 12 aa, Mus sp.
TIPFYTPIPNGL

SEQ ID NO: 7552 - protein, 19 aa, Mus sp.
GPGGKWMIPPEAKESMDKN

SEQ ID NO: 7553 - protein, 16 aa, Mus sp.
NHIEVWERPLSNLAWA

SEQ ID NO: 7554 - protein, 17 aa, Mus sp.
ESPDQWSSSSPHSASDW

SEQ ID NO: 7555 - protein, 16 aa, Mus sp.
LFYLALPPTVYEAVTK

SEQ ID NO: 7556 - protein, 19 aa, Mus sp.
GPKPFSAPKPQTSPSPKPA

SEQ ID NO: 7557 - protein, 17 aa, Mus sp.
LGFPYEGPAPLEAIANG

SEQ ID NO: 7558 - protein, 14 aa, Mus sp.
DGDSYRSPWSNKYD

SEQ ID NO: 7559 - protein, 15 aa, Mus sp.
GTPFWMAPEVIQEIG

SEQ ID NO: 7560 - protein, 21 aa, Mus sp.
SDPSKTGIGAPTISTGPPGKY

SEQ ID NO: 7561 - protein, 20 aa, Mus sp.
VTYVPVTTFKNLQTVNVDEN

SEQ ID NO: 7562 - protein, 13 aa, Mus sp.
EDNVFEAPTLVKV

SEQ ID NO: 7563 - protein, 14 aa, Mus sp.
LVHIFKPDVSPNFG

SEQ ID NO: 7564 - protein, 18 aa, Mus sp.
IPITYPTTAPEIAVPELD

SEQ ID NO: 7565 - protein, 14 aa, Mus sp.
IPTYTKPNPNQIIS

SEQ ID NO: 7566 - protein, 15 aa, Mus sp.
AVDVFFPPEAQNDFP

SEQ ID NO: 7567 - protein, 25 aa, Listeria monocytogenes
DFRYVFDTAKATAASSYPGSDETPP

SEQ ID NO: 7568 - protein, 13 aa, Mus sp.
TSSYSNPTIGYEN

SEQ ID NO: 7569 - protein, 12 aa, Mus sp.
VTYVPVTTFKNL

SEQ ID NO: 7570 - protein, 17 aa, Mus sp.
GRFTYQNAAAQPETGPG

SEQ ID NO: 7571 - protein, 25 aa, Mus sp.
LPGVPPGLEFLVQIDQILIHQKAER

SEQ ID NO: 7572 - protein, 14 aa, Mus sp.
GDIEHPRAIALDPR

SEQ ID NO: 7573 - protein, 10 aa, Mus sp.
DPKISTSLPV

SEQ ID NO: 7574 - protein, 16 aa, Mus sp.
AVDVFFPPEAQNDFPV

SEQ ID NO: 7575 - protein, 16 aa, Mus sp.
TPEYLAPEVLEDNDYG

SEQ ID NO: 7576 - protein, 16 aa, Mus sp.
SALVWLSPSVLVSGAE

SEQ ID NO: 7577 - protein, 16 aa, Mus sp.
IPSGLFIPSMAVGAIA

SEQ ID NO: 7578 - protein, 16 aa, Mus sp.
SILWSQPLPSLPGGPP

SEQ ID NO: 7579 - protein, 24 aa, Mus sp.
LYCGGAEDPDVTASAERRLHKSPG

SEQ ID NO: 7580 - protein, 14 aa, Mus sp.
EGDIFIGPKAEEHR

SEQ ID NO: 7581 - protein, 17 aa, Mus sp.
VDFVAWATGEPNFANDD

SEQ ID NO: 7582 - protein, 15 aa, Mus sp.
REGSYEAAKILLDHF

SEQ ID NO: 7583 - protein, 17 aa, Mus sp.
DGDSYRSPWSNKYDPPL

SEQ ID NO: 7584 - protein, 18 aa, Mus sp.
LPQLRNVGGVRAIPYMQV

SEQ ID NO: 7585 - protein, 19 aa, Mus sp.
DGREVSSVEAPSVSPARHQ

SEQ ID NO: 7586 - protein, 15 aa, Mus sp.
VTQFHPPHIEIQMLK

SEQ ID NO: 7587 - protein, 15 aa, Mus sp.
VDFDFAGPAIHGSAV

SEQ ID NO: 7588 - protein, 17 aa, Mus sp.
AGNFYVPAEPKLAFVIR

SEQ ID NO: 7589 - protein, 17 aa, Mus sp.
LPSTWSDPSVNISLDNL

SEQ ID NO: 7590 - protein, 16 aa, Mus sp.
LFPQYTAPSILPSDIT

SEQ ID NO: 7591 - protein, 14 aa, Mus sp.
GPPIFNPVANEVYL

SEQ ID NO: 7592 - protein, 16 aa, Mus sp.
SLVSWVGSEPMPEAGL

SEQ ID NO: 7593 - protein, 15 aa, Mus sp.
LDKDSFSDPYAHVSF

SEQ ID NO: 7594 - protein, 10 aa, Mus sp.
IPFYTPIPNG

SEQ ID NO: 7595 - protein, 11 aa, Mus sp.
SVFVAPAVTPV

SEQ ID NO: 7596 - protein, 12 aa, Mus sp.
KQIVWNGPVGVF

SEQ ID NO: 7597 - protein, 18 aa, Mus sp.
LPEEVGEYRQPSGGSVPV

SEQ ID NO: 7598 - protein, 15 aa, Mus sp.
TTSSYSNPTIGYENR

SEQ ID NO: 7599 - protein, 16 aa, Mus sp.
DFSTFLSPNVLEEVDS

SEQ ID NO: 7600 - protein, 15 aa, Mus sp.
THDLYIQSHISENRE

SEQ ID NO: 7601 - protein, 16 aa, Mus sp.
AVLEQEPIVLPAWDPM

SEQ ID NO: 7602 - protein, 12 aa, Mus sp.
VNWYAPLVAPIS

SEQ ID NO: 7603 - protein, 15 aa, Mus sp.
SPNYAAPEVISGRLY

SEQ ID NO: 7604 - protein, 18 aa, Listeria monocytogenes
MNRVMLPLQQMGAKMHGK

SEQ ID NO: 7605 - protein, 14 aa, Mus sp.
HTLFHNPHVNPLPT

SEQ ID NO: 7606 - protein, 22 aa, Listeria monocytogenes
YVFDTAKATAASSYPGSDETPP

SEQ ID NO: 7607 - protein, 13 aa, Mus sp.
DPYDQPNAIYIER

SEQ ID NO: 7608 - protein, 12 aa, Mus sp.
IEVAPPKAHEVR

SEQ ID NO: 7609 - protein, 26 aa, Listeria monocytogenes
ADFRYVFDTAKATAASSYPGSDETPP

SEQ ID NO: 7610 - protein, 14 aa, Mus sp.
GSPYIAAKINEAKD

SEQ ID NO: 7611 - protein, 14 aa, Mus sp.
GTPDYIAPEILQGL

SEQ ID NO: 7612 - protein, 15 aa, Mus sp.
SFVQNYPVVSIEDPF

SEQ ID NO: 7613 - protein, 16 aa, Mus sp.
IMFETFNTPAMYVAIQ

SEQ ID NO: 7614 - protein, 15 aa, Mus sp.
GSPYIAAKINEAKDL

SEQ ID NO: 7615 - protein, 19 aa, Mus sp.
INTVTYEWAPPVQNQALAR

SEQ ID NO: 7616 - protein, 15 aa, Mus sp.
FVEEFIWPAVQSSAL

SEQ ID NO: 7617 - protein, 16 aa, Mus sp.
DIYVWRGAQATLSNTT

SEQ ID NO: 7618 - protein, 14 aa, Mus sp.
RDYVPPTANLDQKD

SEQ ID NO: 7619 - protein, 14 aa, Mus sp.
DSYRSPWSNKYDPP

SEQ ID NO: 7620 - protein, 18 aa, Mus sp.
EPPPAYEPPAPAPAPLPP

SEQ ID NO: 7621 - protein, 17 aa, Mus sp.
WKPGSDTIKPDVNKSKE

SEQ ID NO: 7622 - protein, 16 aa, Mus sp.
DVDFDFAGPAIHGSAV

SEQ ID NO: 7623 - protein, 14 aa, Mus sp.
TPYYVAPEVLGPEK

SEQ ID NO: 7624 - protein, 12 aa, Mus sp.
DNIFLSPLSIST

SEQ ID NO: 7625 - protein, 18 aa, Mus sp.
KLLEAKGPVTDVAYSHDG

SEQ ID NO: 7626 - protein, 15 aa, Mus sp.
EVEFSAPYPMEVIFE

SEQ ID NO: 7627 - protein, 17 aa, Mus sp.
ITDKFWGPSGAESVIGG

SEQ ID NO: 7628 - protein, 11 aa, Mus sp.
RYMAPEVLESR

SEQ ID NO: 7629 - protein, 14 aa, Mus sp.
AVLEQEPIVLPAWD

SEQ ID NO: 7630 - protein, 15 aa, Mus sp.
KERASFITPVPGGVG

SEQ ID NO: 7631 - protein, 19 aa, Mus sp.
DDREDITHTYKYPEGSPEE

SEQ ID NO: 7632 - protein, 13 aa, Mus sp.
IILENYAYPGVLL

SEQ ID NO: 7633 - protein, 15 aa, Mus sp.
LTTSSYSNPTIGYEN

SEQ ID NO: 7634 - protein, 13 aa, Mus sp.
TPDYIAPEILQGL

SEQ ID NO: 7635 - protein, 13 aa, Mus sp.
LVFDVTAPNTFKT

SEQ ID NO: 7636 - protein, 19 aa, Listeria monocytogenes
DFRYVFDTAKATAASSYPG

SEQ ID NO: 7637 - protein, 12 aa, Mus sp.
VAFNGPKGGYVA

SEQ ID NO: 7638 - protein, 12 aa, Mus sp.
ALKPEYVAPLVL

SEQ ID NO: 7639 - protein, 14 aa, Mus sp.
QLEALVGPEANVGP

SEQ ID NO: 7640 - protein, 17 aa, Mus sp.
EAIETIVAAMSNLVPPV

SEQ ID NO: 7641 - protein, 19 aa, Mus sp.
GKLLEAKGPVTDVAYSHDG

SEQ ID NO: 7642 - protein, 15 aa, Mus sp.
LSLLYNVPAVAEEIQ

SEQ ID NO: 7643 - protein, 15 aa, Mus sp.
LAWVAFPLALVSGTV

SEQ ID NO: 7644 - protein, 18 aa, Mus sp.
SGPKPFSAPKPQTSPSPK

SEQ ID NO: 7645 - protein, 16 aa, Mus sp.
AAYLWVGAGASEAEKT

SEQ ID NO: 7646 - protein, 13 aa, Mus sp.
LMLYTRKFESTDP

SEQ ID NO: 7647 - protein, 15 aa, Mus sp.
DISNYGFPRSVQAID

SEQ ID NO: 7648 - protein, 16 aa, Mus sp.
EGNTWLTAFVLKSFAQ

SEQ ID NO: 7649 - protein, 25 aa, Mus sp.
GSEIDLKGIPVYRFVLPANAFASPL

SEQ ID NO: 7650 - protein, 15 aa, Mus sp.
TIPFYTPIPNGLYPS

SEQ ID NO: 7651 - protein, 23 aa, Mus sp.
DPTSVTLKPMEIRTFLASVQWQE

SEQ ID NO: 7652 - protein, 15 aa, Mus sp.
AVLEQEPIVLPAWDP

SEQ ID NO: 7653 - protein, 15 aa, Mus sp.
NSEFDPPGPNVATTT

SEQ ID NO: 7654 - protein, 19 aa, Mus sp.
MEKEDRRYNPPIIHQGFQD

SEQ ID NO: 7655 - protein, 12 aa, Listeria monocytogenes
EVVYHNMKQDLE

SEQ ID NO: 7656 - protein, 15 aa, Mus sp.
GPVPWLGPQTDEAIK

SEQ ID NO: 7657 - protein, 16 aa, Mus sp.
APFDWEGAQASQALLL

SEQ ID NO: 7658 - protein, 9 aa, Mus sp.
FVLPANAFA

SEQ ID NO: 7659 - protein, 8 aa, Mus sp.
SALIYSNL

SEQ ID NO: 7660 - protein, 15 aa, Mus sp.
DSVVFAGPAGNSVET

SEQ ID NO: 7661 - protein, 14 aa, Mus sp.
KQEYDESGPSIVHR

SEQ ID NO: 7662 - protein, 15 aa, Mus sp.
FGNIYSTPLALQMLM

SEQ ID NO: 7663 - protein, 16 aa, Mus sp.
LAVLEQEPIVLPAWDP

SEQ ID NO: 7664 - protein, 16 aa, Mus sp.
GGSPYIAAKINEAKDL

SEQ ID NO: 7665 - protein, 15 aa, Mus sp.
SSIYYISSTIAYAVG

SEQ ID NO: 7666 - protein, 18 aa, Mus sp.
VDFVAWATGEPNFANDDE

SEQ ID NO: 7667 - protein, 17 aa, Mus sp.
DDDVNTYNAAIAYTIVS

SEQ ID NO: 7668 - protein, 18 aa, Mus sp.
SPVSETVVTPEAAPEKNP

SEQ ID NO: 7669 - protein, 14 aa, Mus sp.
VLLPFFDPDTNIVY

SEQ ID NO: 7670 - protein, 13 aa, Mus sp.
YKPFQNPVPNQSP

SEQ ID NO: 7671 - protein, 18 aa, Mus sp.
DDEKVRVSYYGPKTSPVQ

SEQ ID NO: 7672 - protein, 18 aa, Mus sp.
YDRALAVVYSVITPFLNP

SEQ ID NO: 7673 - protein, 14 aa, Mus sp.
LALPYDTPVPGYMN

SEQ ID NO: 7674 - protein, 16 aa, Mus sp.
DLVDAVTPSPQPSKEE

SEQ ID NO: 7675 - protein, 18 aa, Mus sp.
LPKPIIWAEPGSVIAAYT

SEQ ID NO: 7676 - protein, 18 aa, Mus sp.
RDGDSYRSPWSNKYDPPL

SEQ ID NO: 7677 - protein, 9 aa, Mus sp.
LDFGSLSNL

SEQ ID NO: 7678 - protein, 17 aa, Mus sp.
DSVTTDHISPAGNIARN

SEQ ID NO: 7679 - protein, 18 aa, Mus sp.
MLDENNHLIQCIMDYQNK

SEQ ID NO: 7680 - protein, 20 aa, Mus sp.
LPPYDDATAVPSTAKEPPPP

SEQ ID NO: 7681 - protein, 15 aa, Mus sp.
GGERFEAPEALFQPH

SEQ ID NO: 7682 - protein, 14 aa, Mus sp.
VTQFHPPHIEIQML

SEQ ID NO: 7683 - protein, 16 aa, Mus sp.
MSTHFWGPVANWGLPI

SEQ ID NO: 7684 - protein, 28 aa, Mus sp.
MQNLGMTSPLPFDSLGYNASHHPFAGYP

SEQ ID NO: 7685 - protein, 17 aa, Mus sp.
TGPPPYHESLAGASQPP

SEQ ID NO: 7686 - protein, 16 aa, Mus sp.
LDQLFSGPLPGRLPVN

SEQ ID NO: 7687 - protein, 13 aa, Mus sp.
YVTQFHPPHIEIQ

SEQ ID NO: 7688 - protein, 16 aa, Mus sp.
GSLGEYLFERLTLKHD

SEQ ID NO: 7689 - protein, 16 aa, Mus sp.
YVTQFHPPHIEIQMLK

SEQ ID NO: 7690 - protein, 19 aa, Mus sp.
KGMKAFVSFVQAYAKHECS

SEQ ID NO: 7691 - protein, 16 aa, Mus sp.
VLDNYLTSPLPEEVDE

SEQ ID NO: 7692 - protein, 17 aa, Mus sp.
VNKGFYKEATQLWGKAE

SEQ ID NO: 7693 - protein, 17 aa, Mus sp.
GYAVYETPTAHNGAKNP

SEQ ID NO: 7694 - protein, 17 aa, Mus sp.
DVDFDFAGPAIHGSAVF

SEQ ID NO: 7695 - protein, 17 aa, Mus sp.
KPPSYNVATTLPSYDEA

SEQ ID NO: 7696 - protein, 16 aa, Mus sp.
PNENCLKQIAVSSVPS

SEQ ID NO: 7697 - protein, 15 aa, Mus sp.
VYIFYGASIASLSAS

SEQ ID NO: 7698 - protein, 24 aa, Mus sp.
SEIDLKGIPVYRFVLPANAFASPL

SEQ ID NO: 7699 - protein, 14 aa, Mus sp.
SVFVAPAVTPVKGV

SEQ ID NO: 7700 - protein, 19 aa, Mus sp.
LPKEELYMPPLVIKVIDHR

SEQ ID NO: 7701 - protein, 16 aa, Mus sp.
TKKFRFEEPVVLPDLS

SEQ ID NO: 7702 - protein, 16 aa, Mus sp.
AEVEFSAPYPMEVIFE

SEQ ID NO: 7703 - protein, 9 aa, Mus sp.
FAYEGRDYI

SEQ ID NO: 7704 - protein, 20 aa, Mus sp.
YPTPAYTIPFYTPIPNGLYP

SEQ ID NO: 7705 - protein, 16 aa, Mus sp.
WKPGSDTIKPDVNKSK

SEQ ID NO: 7706 - protein, 15 aa, Mus sp.
LEMYKVHNPVPLIVG

SEQ ID NO: 7707 - protein, 19 aa, Mus sp.
ENHIEVWERPLSNLAWAVA

SEQ ID NO: 7708 - protein, 18 aa, Mus sp.
DFYPFDGPSGLLAHAFPP

SEQ ID NO: 7709 - protein, 14 aa, Mus sp.
RQTTQYPEANALVR

SEQ ID NO: 7710 - protein, 20 aa, Listeria monocytogenes
ADFRYVFDTAKATAASSYPG

SEQ ID NO: 7711 - protein, 18 aa, Mus sp.
VPDFSDYRRAEVLDSTKS

SEQ ID NO: 7712 - protein, 16 aa, Mus sp.
NVTELNEPLSNEERNL

SEQ ID NO: 7713 - protein, 15 aa, Mus sp.
SLFLKTPKIVSSKDY

SEQ ID NO: 7714 - protein, 16 aa, Mus sp.
VPDDLLYSFPVVIKNK

SEQ ID NO: 7715 - protein, 17 aa, Mus sp.
GNHTLFHNPHVNPLPTG

SEQ ID NO: 7716 - protein, 14 aa, Mus sp.
TIPFYTPIPNGLYP

SEQ ID NO: 7717 - protein, 23 aa, Mus sp.
ADHVGTYGISVYQSPGDIGQYTF

SEQ ID NO: 7718 - protein, 19 aa, Mus sp.
SPESPDQWSSSSPHSASDW

SEQ ID NO: 7719 - protein, 23 aa, Mus sp.
EPGLFEWTKWVAGSTLPAWIPPS

SEQ ID NO: 7720 - protein, 21 aa, Mus sp.
NGNPLNSVFVAPAVTPVKGVL

SEQ ID NO: 7721 - protein, 15 aa, Mus sp.
YPNQVYYRPVDQYSN

SEQ ID NO: 7722 - protein, 15 aa, Mus sp.
FRLWDFRDPSIHSVN

SEQ ID NO: 7723 - protein, 17 aa, Mus sp.
LKYHFVTPLTSMVVTKP

SEQ ID NO: 7724 - protein, 14 aa, Mus sp.
YTIPFYTPIPNGLY

SEQ ID NO: 7725 - protein, 17 aa, Mus sp.
GPYQAAAGPSVVPTAPP

SEQ ID NO: 7726 - protein, 13 aa, Mus sp.
NSEFDPPGPNVAT

SEQ ID NO: 7727 - protein, 14 aa, Mus sp.
IETIVAAMSNLVPP

SEQ ID NO: 7728 - protein, 12 aa, Mus sp.
IVKYELPLVIKA

SEQ ID NO: 7729 - protein, 18 aa, Mus sp.
SWKTFLKYSEEVLAVFKS

SEQ ID NO: 7730 - protein, 14 aa, Mus sp.
EEWGPFKAPHANRF

SEQ ID NO: 7731 - protein, 20 aa, Mus sp.
LPDLTNIHFPSPLPTPLDPE

SEQ ID NO: 7732 - protein, 21 aa, Mus sp.
RPDAFAISYVAALPAAALWHK

SEQ ID NO: 7733 - protein, 17 aa, Mus sp.
TSSLAAPTVEAAASAPA

SEQ ID NO: 7734 - protein, 17 aa, Mus sp.
YVTQFHPPHIEIQMLKN

SEQ ID NO: 7735 - protein, 11 aa, Mus sp.
EDRRYNPPIIH

SEQ ID NO: 7736 - protein, 23 aa, Mus sp.
LPDLTNIHFPSPLPTPLDPEEPP

SEQ ID NO: 7737 - protein, 10 aa, Mus sp.
LWPWPQYIQT

SEQ ID NO: 7738 - protein, 14 aa, Mus sp.
KIVYEGPELNHAFG

SEQ ID NO: 7739 - protein, 18 aa, Mus sp.
RPDAEYWNSQPEILERTR

SEQ ID NO: 7740 - protein, 14 aa, Mus sp.
AVNWYAPLVAPISK

SEQ ID NO: 7741 - protein, 16 aa, Mus sp.
RRTDWEAPTGQPSAPG

SEQ ID NO: 7742 - protein, 15 aa, Mus sp.
LALPYDTPVPGYMNN

SEQ ID NO: 7743 - protein, 18 aa, Mus sp.
DHAISDLSMYNYIEMRAH

SEQ ID NO: 7744 - protein, 13 aa, Mus sp.
IPFYTPIPNGLYP

SEQ ID NO: 7745 - protein, 16 aa, Mus sp.
GCKVRDHMVVLHDQGE

SEQ ID NO: 7746 - protein, 13 aa, Mus sp.
EWKDYKAGFGNLE

SEQ ID NO: 7747 - protein, 16 aa, Mus sp.
LPSTWSDPSVNISLDN

SEQ ID NO: 7748 - protein, 14 aa, Mus sp.
TLPDFHVPEITIPE

SEQ ID NO: 7749 - protein, 14 aa, Mus sp.
GPKPFSAPKPQTSP

SEQ ID NO: 7750 - protein, 15 aa, Mus sp.
LEEIYLFSLPIKESE

SEQ ID NO: 7751 - protein, 14 aa, Mus sp.
DPDGFSWPATLPSV

SEQ ID NO: 7752 - protein, 16 aa, Mus sp.
EEEEVEVFLPKFKLEE

SEQ ID NO: 7753 - protein, 18 aa, Mus sp.
AAPHIYQNSFVQVVLNSL

SEQ ID NO: 7754 - protein, 14 aa, Mus sp.
FYVDLDKKETVWML

SEQ ID NO: 7755 - protein, 20 aa, Mus sp.
HDGDSVVFAGPAGNSVETRG

SEQ ID NO: 7756 - protein, 13 aa, Mus sp.
RSNEFDYPSVGQL

SEQ ID NO: 7757 - protein, 15 aa, Mus sp.
HTLFHNPHVNPLPTG

SEQ ID NO: 7758 - protein, 16 aa, Mus sp.
DEGERYIAPTVLVDVQ

SEQ ID NO: 7759 - protein, 19 aa, Mus sp.
SPLPILSPTVSPSPSPIPP

SEQ ID NO: 7760 - protein, 15 aa, Mus sp.
AVDALASSHPLSSPA

SEQ ID NO: 7761 - protein, 17 aa, Mus sp.
KEDRRYNPPIIHQGFQD

SEQ ID NO: 7762 - protein, 18 aa, BOVIN
PPVASVVVGPSVVAVPLP

SEQ ID NO: 7763 - protein, 16 aa, Mus sp.
NLDYWTYPGSLTTPPL

SEQ ID NO: 7764 - protein, 21 aa, Mus sp.
IGYREYSTGGNFQFNIISIDT

SEQ ID NO: 7765 - protein, 13 aa, Mus sp.
YTIPFYTPIPNGL

SEQ ID NO: 7766 - protein, 15 aa, Mus sp.
IEGYVPSQADVAVFE

SEQ ID NO: 7767 - protein, 14 aa, Mus sp.
IPFYTPIPNGLYPS

SEQ ID NO: 7768 - protein, 15 aa, Mus sp.
YFETAVSRPGLEEPR

SEQ ID NO: 7769 - protein, 16 aa, Mus sp.
HDLDFRAPHVLVLGSG

SEQ ID NO: 7770 - protein, 15 aa, Mus sp.
FDIFYTAPQPGKYVI

SEQ ID NO: 7771 - protein, 15 aa, Mus sp.
LGTEEISPRVLQSLG

SEQ ID NO: 7772 - protein, 16 aa, Mus sp.
IPPTHYAASRAASVAE

SEQ ID NO: 7773 - protein, 25 aa, Mus sp.
DAGTIAGLNVLRIINEPTAAAIAYG

SEQ ID NO: 7774 - protein, 21 aa, BOVIN
AGPPVASVVVGPSVVAVPLPL

SEQ ID NO: 7775 - protein, 14 aa, Mus sp.
EDFYGSPIPSVSLK

SEQ ID NO: 7776 - protein, 11 aa, Mus sp.
GIYTYGKPVPG

SEQ ID NO: 7777 - protein, 17 aa, Mus sp.
EDNVFEAPTLVKVFKQP

SEQ ID NO: 7778 - protein, 17 aa, Mus sp.
SPTSPSYSPTSPNYSPT

SEQ ID NO: 7779 - protein, 15 aa, Mus sp.
PDGFSWPATLPSVYK

SEQ ID NO: 7780 - protein, 15 aa, BOVIN
ASVVVGPSVVAVPLP

SEQ ID NO: 7781 - protein, 16 aa, Mus sp.
YTIPFYTPIPNGLYPS

SEQ ID NO: 7782 - protein, 16 aa, Mus sp.
DSVVFAGPAGNSVETR

SEQ ID NO: 7783 - protein, 8 aa, Mus sp.
AVYSFEAL

SEQ ID NO: 7784 - protein, 15 aa, Mus sp.
AEVEFSAPYPMEVIF

SEQ ID NO: 7785 - protein, 12 aa, Mus sp.
VDFIGSTVGLAK

SEQ ID NO: 7786 - protein, 8 aa, Mus sp.
ITGYFPSM

SEQ ID NO: 7787 - protein, 14 aa, Mus sp.
GVLLPFFDPDTNIV

SEQ ID NO: 7788 - protein, 16 aa, Mus sp.
SVGAWTGPMGNWAMFT

SEQ ID NO: 7789 - protein, 15 aa, Mus sp.
SLVQTYVGAISNGSL

SEQ ID NO: 7790 - protein, 14 aa, Mus sp.
LEDFYGSPIPSVSL

SEQ ID NO: 7791 - protein, 15 aa, Mus sp.
VPTVPLLPPQVNQSL

SEQ ID NO: 7792 - protein, 16 aa, Mus sp.
NLRDNYRFAHTNIESL

SEQ ID NO: 7793 - protein, 14 aa, Mus sp.
GLPDYSAPNPIKVT

SEQ ID NO: 7794 - protein, 17 aa, Mus sp.
ATPRDYYFALAHTVRDH

SEQ ID NO: 7795 - protein, 11 aa, Mus sp.
VFVAPAVTPVK

SEQ ID NO: 7796 - protein, 17 aa, Mus sp.
GNMHYDTPDIRRFDPVP

SEQ ID NO: 7797 - protein, 16 aa, Mus sp.
DGDSYRSPWSNKYDPP

SEQ ID NO: 7798 - protein, 14 aa, Mus sp.
APDTRFVAPGALGN

SEQ ID NO: 7799 - protein, 14 aa, Mus sp.
TPDYIAPEILQGLK

SEQ ID NO: 7800 - protein, 16 aa, Mus sp.
GNHTLFHNPHVNPLPT

SEQ ID NO: 7801 - protein, 17 aa, Mus sp.
NPLNSVFVAPAVTPVKG

SEQ ID NO: 7802 - protein, 17 aa, Mus sp.
EQIYYAGPVNNPGLDVP

SEQ ID NO: 7803 - protein, 25 aa, Mus sp.
GAGIIDVIKSGYKIPELSQSLDYIQ

SEQ ID NO: 7804 - protein, 19 aa, Mus sp.
NPGNPHNVYMPTSQPPPPP

SEQ ID NO: 7805 - protein, 16 aa, Mus sp.
SALEYGMPVTLIGEAV

SEQ ID NO: 7806 - protein, 16 aa, Mus sp.
TIQWWNMPSPNVDPYD

SEQ ID NO: 7807 - protein, 17 aa, Mus sp.
LLGNMWAQTWSNIYDLV

SEQ ID NO: 7808 - protein, 15 aa, Mus sp.
TKVVFLSPAVPEEPE

SEQ ID NO: 7809 - protein, 22 aa, Mus sp.
EEKYHEALAKGDVTTQVALQPA

SEQ ID NO: 7810 - protein, 18 aa, Mus sp.
EPPSDLDFFSPRPVPAAS

SEQ ID NO: 7811 - protein, 15 aa, Mus sp.
EVGEYRQPSGGSVPV

SEQ ID NO: 7812 - protein, 16 aa, Mus sp.
AEPQAEAPAAAASSEQ

SEQ ID NO: 7813 - protein, 19 aa, Mus sp.
NPLNSVFVAPAVTPVKGVL

SEQ ID NO: 7814 - protein, 15 aa, Mus sp.
LPDVYDWPESSLTPP

SEQ ID NO: 7815 - protein, 18 aa, Mus sp.
LNVLRIINEPTAAAIAYG

SEQ ID NO: 7816 - protein, 16 aa, Mus sp.
RVSSWDVPTVVPVPFE

SEQ ID NO: 7817 - protein, 9 aa, Mus sp.
QILSDFPKL

SEQ ID NO: 7818 - protein, 15 aa, Mus sp.
GGSPYIAAKINEAKD

SEQ ID NO: 7819 - protein, 20 aa, Mus sp.
DLPKNWDWRNVNGVNYASVT

SEQ ID NO: 7820 - protein, 19 aa, Mus sp.
GDFYPFDGPSGLLAHAFPP

SEQ ID NO: 7821 - protein, 15 aa, Mus sp.
GIHHWTPPKGHVDPG

SEQ ID NO: 7822 - protein, 14 aa, Mus sp.
VYIFYGASIASLSA

SEQ ID NO: 7823 - protein, 14 aa, Mus sp.
FDIFYTAPQPGKYV

SEQ ID NO: 7824 - protein, 15 aa, Mus sp.
LPDYSAPNPIKVTHR

SEQ ID NO: 7825 - protein, 16 aa, Mus sp.
SPDQWSSSSPHSASDW

SEQ ID NO: 7826 - protein, 15 aa, Mus sp.
NLDYVATSIHEAVTK

SEQ ID NO: 7827 - protein, 18 aa, Mus sp.
GPEPGPYAQPSVNTPLPN

SEQ ID NO: 7828 - protein, 17 aa, Mus sp.
LTTSSYSNPTIGYENRV

SEQ ID NO: 7829 - protein, 17 aa, Mus sp.
VLRYNITHPVVNDADAS

SEQ ID NO: 7830 - protein, 13 aa, Mus sp.
SVGAWTGPMGNWA

SEQ ID NO: 7831 - protein, 23 aa, Mus sp.
EIDLKGIPVYRFVLPANAFASPL

SEQ ID NO: 7832 - protein, 15 aa, Mus sp.
DSYRSPWSNKYDPPL

SEQ ID NO: 7833 - protein, 17 aa, Mus sp.
RPDAEYWNSQPEILERT

SEQ ID NO: 7834 - protein, 16 aa, Mus sp.
KYHFVTPLTSMVVTKP

SEQ ID NO: 7835 - protein, 17 aa, Mus sp.
KNLDYVATSIHEAVTKI

SEQ ID NO: 7836 - protein, 14 aa, Mus sp.
AGGHKLGLGLEFQA

SEQ ID NO: 7837 - protein, 14 aa, Mus sp.
FQINQDEEEEEDED

SEQ ID NO: 7838 - protein, 19 aa, Mus sp.
IQASVATNPIITPVAQENQ

SEQ ID NO: 7839 - protein, 34 aa, Listeria monocytogenes; identical to SEQ ID NO: 591

SEQ ID NO: 7840 - protein, 16 aa, Mus sp.
DEEEVEVFLPKFKLEE

SEQ ID NO: 7841 - protein, 17 aa, Listeria monocytogenes
TKEKVVATPVSNVSTSS

SEQ ID NO: 7842 - protein, 13 aa, Mus sp.
FPYVTPAPHEPVK

SEQ ID NO: 7843 - protein, 18 aa, Mus sp.
DPKYRTWAWEAVEALESH

SEQ ID NO: 7844 - protein, 17 aa, Mus sp.
GGSPYIAAKINEAKDLL

SEQ ID NO: 7845 - protein, 14 aa, Mus sp.
AWVAFPLALVSGTV

SEQ ID NO: 7846 - protein, 15 aa, Mus sp.
GDISISGPKVNVEAP

SEQ ID NO: 7847 - protein, 11 aa, Mus sp.
VPWSPPQSNWN

SEQ ID NO: 7848 - protein, 17 aa, Mus sp.
DPTNPFRFPNIGVEKFL

SEQ ID NO: 7849 - protein, 19 aa, Mus sp.
IGDTIEFRGPNGLLVYQGK

SEQ ID NO: 7850 - protein, 15 aa, Mus sp.
KGFYKEATQLWGKAE

SEQ ID NO: 7851 - protein, 14 aa, Mus sp.
VTYEWAPPVQNQAL

SEQ ID NO: 7852 - protein, 16 aa, Mus sp.
EDKVYWTDVINEAIFS

SEQ ID NO: 7853 - protein, 14 aa, Mus sp.
TTSSYSNPTIGYEN

SEQ ID NO: 7854 - protein, 16 aa, Mus sp.
FPDNYNSPTPYKIQYN

SEQ ID NO: 7855 - protein, 15 aa, Mus sp.
AIFSYEAAQPEDLEF

SEQ ID NO: 7856 - protein, 15 aa, Mus sp.
FVAWATGEPNFANDD

SEQ ID NO: 7857 - protein, 14 aa, Mus sp.
EVSSVEAPSVSPAR

SEQ ID NO: 7858 - protein, 16 aa, Mus sp.
IGNERFRCPEAIFQPS

SEQ ID NO: 7859 - protein, 18 aa, Mus sp.
INRLDNYDAPDIANIAIS

SEQ ID NO: 7860 - protein, 17 aa, Mus sp.
GPGGLWVWGAPAVAQLL

SEQ ID NO: 7861 - protein, 17 aa, Mus sp.
TPENEDLHAATVNPDPS

SEQ ID NO: 7862 - protein, 15 aa, Mus sp.
EVDRYDAPGIAFYPG

SEQ ID NO: 7863 - protein, 17 aa, Mus sp.
NLRDNYRFAHTNIESLV

SEQ ID NO: 7864 - protein, 15 aa, Mus sp.
IDPYDQPNAIYIERH

SEQ ID NO: 7865 - protein, 27 aa, Mus sp.
SNDTTVLLPPYDDATAVPSTAKEPPPP

SEQ ID NO: 7866 - protein, 20 aa, Mus sp.
YTWSDAAAPFAGLSTDQTLR

SEQ ID NO: 7867 - protein, 15 aa, Mus sp.
PLNSVFVAPAVTPVK

SEQ ID NO: 7868 - protein, 17 aa, Mus sp.
RTDWEAPTGQPSAPGPR

SEQ ID NO: 7869 - protein, 17 aa, Mus sp.
LPKEELYMPPLVIKVID

SEQ ID NO: 7870 - protein, 22 aa, Mus sp.
IDLKGIPVYRFVLPANAFASPL

SEQ ID NO: 7871 - protein, 17 aa, Mus sp.
SPNKLYTLVTYVPVTTF

SEQ ID NO: 7872 - protein, 15 aa, Mus sp.
LDQLFSGPLPGRLPV

SEQ ID NO: 7873 - protein, 13 aa, Mus sp.
DYVPPTANLDQKD

SEQ ID NO: 7874 - protein, 17 aa, Mus sp.
EVKDYEPPFGSKVREHP

SEQ ID NO: 7875 - protein, 9 aa, Mus sp.
YIAPEILQG

SEQ ID NO: 7876 - protein, 17 aa, Mus sp.
FGNSEFDPPGPNVATTT

SEQ ID NO: 7877 - protein, 20 aa, Mus sp.
DVVDRVLKSPVASIVYELNP

SEQ ID NO: 7878 - protein, 16 aa, Mus sp.
IGGDPFAAPQVVPAFA

SEQ ID NO: 7879 - protein, 15 aa, Mus sp.
TAQWNICLPLLQHNL

SEQ ID NO: 7880 - protein, 20 aa, Mus sp.
EPPQVPAEAPQPRASEDSPR

SEQ ID NO: 7881 - protein, 16 aa, Mus sp.
VDFDFAGPAIHGSAVF

SEQ ID NO: 7882 - protein, 18 aa, Mus sp.
SIASFKDPKISTSLPVLD

SEQ ID NO: 7883 - protein, 15 aa, Mus sp.
DFITMNPSVVQRAFG

SEQ ID NO: 7884 - protein, 19 aa, Mus sp.
LAPMYYRGAQAAIVVYDIT

SEQ ID NO: 7885 - protein, 13 aa, Mus sp.
MYKVHNPVPLIVG

SEQ ID NO: 7886 - protein, 16 aa, Mus sp.
SIASFKDPKISTSLPV

SEQ ID NO: 7887 - protein, 19 aa, Mus sp.
MPNPKDNEVNHIRATCFNS

SEQ ID NO: 7888 - protein, 16 aa, Mus sp.
SPTGNIFFSPFSISSA

SEQ ID NO: 7889 - protein, 15 aa, Mus sp.
EKQGFHSGTPAASFN

SEQ ID NO: 7890 - protein, 14 aa, Mus sp.
VNFQEYVAFLGALA

SEQ ID NO: 7891 - protein, 19 aa, Mus sp.
DYLNSDGSAKSSCVSKDVP

SEQ ID NO: 7892 - protein, 16 aa, Mus sp.
LALPYDTPVPGYMNNT

SEQ ID NO: 7893 - protein, 15 aa, Mus sp.
KGQDHVDFSQPEPHT

SEQ ID NO: 7894 - protein, 14 aa, Mus sp.
GDDWTIFQSNHSTY

SEQ ID NO: 7895 - protein, 16 aa, Mus sp.
DGQSVQWWHPQGIIGL

SEQ ID NO: 7896 - protein, 16 aa, Mus sp.
FDQGYEAPGVREAAAA

SEQ ID NO: 7897 - protein, 13 aa, Mus sp.
YYRGAQAAIVVYD

SEQ ID NO: 7898 - protein, 14 aa, Mus sp.
NIPYFETSAKEAIN

SEQ ID NO: 7899 - protein, 14 aa, Mus sp.
FGNIYSTPLALQML

SEQ ID NO: 7900 - protein, 8 aa, Mus sp.
AAYEFTTL

SEQ ID NO: 7901 - protein, 15 aa, Mus sp.
SIPDYWDPAALPDLG

SEQ ID NO: 7902 - protein, 14 aa, Mus sp.
VEPYEVHNPVPLIV

SEQ ID NO: 7903 - protein, 21 aa, Mus sp.
GIKADKADKAAASGPASASAP

SEQ ID NO: 7904 - protein, 14 aa, Mus sp.
LPYDTPVPGYMNNT

SEQ ID NO: 7905 - protein, 14 aa, Mus sp.
DNIFLSPLSISTAF

SEQ ID NO: 7906 - protein, 19 aa, Mus sp.
YNIPFTEKNILYSAFLWRT

SEQ ID NO: 7907 - protein, 15 aa, Mus sp.
DGDSYRSPWSNKYDP

SEQ ID NO: 7908 - protein, 13 aa, Mus sp.
LIEVSSPITLQAL

SEQ ID NO: 7909 - protein, 20 aa, Mus sp.
KIQASVATNPIITPVAQENQ

SEQ ID NO: 7910 - protein, 26 aa, Mus sp.
TPARAPETRSQVTPSVPSEALDDSTG

SEQ ID NO: 7911 - protein, 14 aa, Mus sp.
TPATNEAPQATVFP

SEQ ID NO: 7912 - protein, 16 aa, Mus sp.
TSWTYNPAAVSKVAPA

SEQ ID NO: 7913 - protein, 15 aa, Mus sp.
SALEYGMPVTLIGEA

SEQ ID NO: 7914 - protein, 20 aa, Mus sp.
GQDHVDFSQPEPHTVLFHEP

SEQ ID NO: 7915 - protein, 11 aa, Mus sp.
TPWKAPIVWEG

SEQ ID NO: 7916 - protein, 18 aa, Mus sp.
HPPQEATNSPKPQPSYEE

SEQ ID NO: 7917 - protein, 14 aa, Mus sp.
TKWFSAPLLLEASE

SEQ ID NO: 7918 - protein, 24 aa, Mus sp.
LPEEVGEYRQPSGGSVPVSPGPPS

SEQ ID NO: 7919 - protein, 18 aa, BOVIN
GPPVASVVVGPSVVAVPL

SEQ ID NO: 7920 - protein, 17 aa, Mus sp.
GAVIFNFPGTRNEVIPM

SEQ ID NO: 7921 - protein, 16 aa, Mus sp.
FVAWATGEPNFANDDE

SEQ ID NO: 7922 - protein, 19 aa, Mus sp.
KPTVTVVSPLPNDSINPQP

SEQ ID NO: 7923 - protein, 15 aa, Mus sp.
LAVLEQEPIVLPAWD

SEQ ID NO: 7924 - protein, 16 aa, Mus sp.
YYLPYKSPGINVDSSY

SEQ ID NO: 7925 - protein, 20 aa, Mus sp.
YPRDISNYGFPRSVQAIDAA

SEQ ID NO: 7926 - protein, 15 aa, Mus sp.
GKFIYITPEELAAVA

SEQ ID NO: 7927 - protein, 17 aa, Mus sp.
ETELDQLFSGPLPGRLP

SEQ ID NO: 7928 - protein, 18 aa, Mus sp.
NGKTELNYKNTEPVLDSD

SEQ ID NO: 7929 - protein, 17 aa, Mus sp.
VGTARYMAPEVLESRMN

SEQ ID NO: 7930 - protein, 15 aa, Mus sp.
GDFYYHAAIFGGTPT

SEQ ID NO: 7931 - protein, 15 aa, Mus sp.
KFLPNAPKALIVEPS

SEQ ID NO: 7932 - protein, 15 aa, Mus sp.
AELQTLAPAINWLPF

SEQ ID NO: 7933 - protein, 14 aa, Mus sp.
VEFSAPYPMEVIFE

SEQ ID NO: 7934 - protein, 16 aa, Mus sp.
TTVEYLAPWANQIDMA

SEQ ID NO: 7935 - protein, 15 aa, Mus sp.
SFPKFKGSLALRTLD

SEQ ID NO: 7936 - protein, 17 aa, Mus sp.
INPDNVATPIAASFGDL

SEQ ID NO: 7937 - protein, 12 aa, Mus sp.
TPDYIAPEILQG

SEQ ID NO: 7938 - protein, 15 aa, Mus sp.
TTVSLSAPDALKIIT

SEQ ID NO: 7939 - protein, 18 aa, Mus sp.
ARDNMFSGSKINYTENRA

SEQ ID NO: 7940 - protein, 15 aa, Mus sp.
LELEEPPLVLAAANV

SEQ ID NO: 7941 - protein, 19 aa, Mus sp.
ADWQGGVYASPSIAGSRPG

SEQ ID NO: 7942 - protein, 17 aa, Mus sp.
TDRKIVYEGPELNHAFG

SEQ ID NO: 7943 - protein, 16 aa, Mus sp.
GLELEEPPLVLAAANV

SEQ ID NO: 7944 - protein, 12 aa, Mus sp.
NPIITPVAQENQ

SEQ ID NO: 7945 - protein, 15 aa, Mus sp.
RESKVVVPPLPGKAF

SEQ ID NO: 7946 - protein, 14 aa, Mus sp.
AFSNPSAGISVDVK

SEQ ID NO: 7947 - protein, 14 aa, Mus sp.
APFDWEGAQASQAL

SEQ ID NO: 7948 - protein, 21 aa, Mus sp.
DVVDRVLKSPVASIVYELNPN

SEQ ID NO: 7949 - protein, 15 aa, Mus sp.
SVTYYGPSGQKTIYS

SEQ ID NO: 7950 - protein, 20 aa, Mus sp.
DSVTTDHISPAGNIARNSPA

SEQ ID NO: 7951 - protein, 15 aa, Mus sp.
ELDQLFSGPLPGRLP

SEQ ID NO: 7952 - protein, 16 aa, Mus sp.
YPDSWSTPHSYFSLKF

SEQ ID NO: 7953 - protein, 16 aa, Mus sp.
DDLFVEEPKTNDVKDS

SEQ ID NO: 7954 - protein, 14 aa, Mus sp.
VPWSPPQSNWNPWT

SEQ ID NO: 7955 - protein, 17 aa, Mus sp.
KYQNVSGFSNVNINRHS

SEQ ID NO: 7956 - protein, 16 aa, Mus sp.
DTIEFRGPNGLLVYQG

SEQ ID NO: 7957 - protein, 13 aa, Mus sp.
FPQYTAPSILPSD

SEQ ID NO: 7958 - protein, 15 aa, Mus sp.
TPDYIAPEIIAYQPY

SEQ ID NO: 7959 - protein, 18 aa, Mus sp.
VGTARYMAPEVLESRMNL

SEQ ID NO: 7960 - protein, 15 aa, Mus sp.
GKKFTAPHILIATGG

SEQ ID NO: 7961 - protein, 14 aa, BOVIN
VVVGPSVVAVPLPL

SEQ ID NO: 7962 - protein, 15 aa, Mus sp.
TVIHFNNPKVQASLS

SEQ ID NO: 7963 - protein, 14 aa, Mus sp.
FPYVTPAPHEPVKT

SEQ ID NO: 7964 - protein, 15 aa, Mus sp.
IPISKVKDVYVITDQ

SEQ ID NO: 7965 - protein, 17 aa, Mus sp.
AKQIVWNGPVGVFEWEA

SEQ ID NO: 7966 - protein, 17 aa, Mus sp.
VGTKRYMAPEVLDDSIN

SEQ ID NO: 7967 - protein, 14 aa, Mus sp.
RLEQPNVVISLSRT

SEQ ID NO: 7968 - protein, 16 aa, Mus sp.
KFIYVDVLPEEAVGPV

SEQ ID NO: 7969 - protein, 17 aa, Mus sp.
IPPTHYAASRAASVAEN

SEQ ID NO: 7970 - protein, 21 aa, Mus sp.
HPDKGGSPYIAAKINEAKDLL

SEQ ID NO: 7971 - protein, 14 aa, Mus sp.
APPHFHFGQTNRTP

SEQ ID NO: 7972 - protein, 17 aa, Mus sp.
INPDNVATPIAASLGDL

SEQ ID NO: 7973 - protein, 15 aa, Mus sp.
SSEVYTFPVPERHLE

SEQ ID NO: 7974 - protein, 15 aa, Mus sp.
GPKPFSAPKPQTSPS

SEQ ID NO: 7975 - protein, 28 aa, Mus sp.
LLDFGSLSNLQVTQPTVGMNFKTPRGAV

SEQ ID NO: 7976 - protein, 14 aa, Mus sp.
SLFLKTPKIVSSKD

SEQ ID NO: 7977 - protein, 20 aa, Mus sp.
EPPPAYEPPAPAPAPLPPPS

SEQ ID NO: 7978 - protein, 15 aa, Mus sp.
ITDKFWGPSGAESVI

SEQ ID NO: 7979 - protein, 15 aa, Mus sp.
ATFGVSGGHINPAVS

SEQ ID NO: 7980 - protein, 21 aa, Mus sp.
ITVKELFTTPVLRASVSSPFP

SEQ ID NO: 7981 - protein, 19 aa, Mus sp.
EDPDGFSWPATLPSVYKQP

SEQ ID NO: 7982 - protein, 16 aa, Mus sp.
SKEAFQEALAAAGDKL

SEQ ID NO: 7983 - protein, 11 aa, Mus sp.
IPFYTPIPNGL

SEQ ID NO: 7984 - protein, 19 aa, Mus sp.
EEKPVPAAPVPSPVAPAPV

SEQ ID NO: 7985 - protein, 18 aa, Mus sp.
SMRYFETAVSRPGLEEPR

SEQ ID NO: 7986 - protein, 12 aa, Mus sp.
EAGAFNAPVINR

SEQ ID NO: 7987 - protein, 12 aa, Mus sp.
YTIPFYTPIPNG

SEQ ID NO: 7988 - protein, 18 aa, Mus sp.
HPAPPVASSPTVIPGEPR

SEQ ID NO: 7989 - protein, 24 aa, Mus sp.
IPELNGKLTGMAFRVPTPNVSVVD

SEQ ID NO: 7990 - protein, 15 aa, Mus sp.
EDPDGFSWPATLPSV

SEQ ID NO: 7991 - protein, 16 aa, Mus sp.
YPHIVVGALAASAPIW

SEQ ID NO: 7992 - protein, 16 aa, Mus sp.
ATEEKYHEALAKGDVT

SEQ ID NO: 7993 - protein, 15 aa, Mus sp.
DVPFTLAPHVLAAQG

SEQ ID NO: 7994 - protein, 14 aa, Mus sp.
LDNYDAPDIANIAI

SEQ ID NO: 7995 - protein, 15 aa, Mus sp.
APYQGPDAAPGALDY

SEQ ID NO: 7996 - protein, 17 aa, Mus sp.
RFGPYYTEPVIAGLDPK

SEQ ID NO: 7997 - protein, 23 aa, Listeria monocytogenes
AVDDTTVKFTLPTVAPAFENTIK

SEQ ID NO: 7998 - protein, 15 aa, Mus sp.
EKPVPAAPVPSPVAP

SEQ ID NO: 7999 - protein, 13 aa, Mus sp.
HTLFHNPHVNPLP

SEQ ID NO: 8000 - protein, 14 aa, Mus sp.
KSKYKASIAALEAK

SEQ ID NO: 8001 - protein, 15 aa, Mus sp.
GTVIHFNNPKVQASL

SEQ ID NO: 8002 - protein, 14 aa, Mus sp.
YASWAANQINRAYQ

SEQ ID NO: 8003 - protein, 18 aa, Mus sp.
STHSNSISFGSAPTTSVS

SEQ ID NO: 8004 - protein, 16 aa, Mus sp.
IPETYPFNPPKVRFIT

SEQ ID NO: 8005 - protein, 17 aa, Mus sp.
IGVGAYVSPDMMVAEYS

SEQ ID NO: 8006 - protein, 15 aa, Mus sp.
FGPYYTEPVIAGLDP

SEQ ID NO: 8007 - protein, 17 aa, Mus sp.
GVPDDLLYSFPVVIKNK

SEQ ID NO: 8008 - protein, 17 aa, Mus sp.
RITPSYVAFTPEGERLI

SEQ ID NO: 8009 - protein, 15 aa, Mus sp.
KPSGYNPPISILGIL

SEQ ID NO: 8010 - protein, 15 aa, Mus sp.
SVFVAPAVTPVKGVL

SEQ ID NO: 8011 - protein, 13 aa, Mus sp.
DKEFHAPLIIDEN

SEQ ID NO: 8012 - protein, 16 aa, Mus sp.
GFLSEIGSQALAAGSY

SEQ ID NO: 8013 - protein, 15 aa, Mus sp.
VDMARVVAPFMSNIP

SEQ ID NO: 8014 - protein, 15 aa, Mus sp.
HDLDFRAPHVLVLGS

SEQ ID NO: 8015 - protein, 20 aa, Mus sp.
YPPSGPTYRGPVPWHTINLD

SEQ ID NO: 8016 - protein, 14 aa, Mus sp.
NPPSYYTQPVPVPN

SEQ ID NO: 8017 - protein, 14 aa, Mus sp.
ISALEYGMPVTLIG

SEQ ID NO: 8018 - protein, 16 aa, Mus sp.
GTPEYLAPEVLEDNDY

SEQ ID NO: 8019 - protein, 15 aa, Mus sp.
FGNSEFDPPGPNVAT

SEQ ID NO: 8020 - protein, 17 aa, Mus sp.
KNVTELNEPLSNEERNL

SEQ ID NO: 8021 - protein, 20 aa, Mus sp.
DGELTYENVQVSPVPGGPPG

SEQ ID NO: 8022 - protein, 13 aa, Mus sp.
FGNIYSTPLALQM

SEQ ID NO: 8023 - protein, 19 aa, Mus sp.
VGAGHFRSPHTTEVVGGAP

SEQ ID NO: 8024 - protein, 15 aa, Mus sp.
QLEALVGPEANVGPY

SEQ ID NO: 8025 - protein, 15 aa, Mus sp.
FPQYTAPSILPSDIT

SEQ ID NO: 8026 - protein, 20 aa, Mus sp.
SPTSPSYSPTSPSYSPTSPS

SEQ ID NO: 8027 - protein, 26 aa, Mus sp.
TTILYKLKGNQLVDTLPTVGFNVEPL

SEQ ID NO: 8028 - protein, 12 aa, Mus sp.
FSYAFPKAVSVF

SEQ ID NO: 8029 - protein, 18 aa, Mus sp.
DWQGGVYASPSIAGSRPG

SEQ ID NO: 8030 - protein, 15 aa, Mus sp.
VAWATGEPNFANDDE

SEQ ID NO: 8031 - protein, 16 aa, Mus sp.
YPFDFQGAKIITGQEE

SEQ ID NO: 8032 - protein, 16 aa, Mus sp.
KNLDYVATSIHEAVTK

SEQ ID NO: 8033 - protein, 17 aa, Mus sp.
VDEYDYSKPIQGQQKKP

SEQ ID NO: 8034 - protein, 15 aa, Mus sp.
VPIYEGYALPHAILR

SEQ ID NO: 8035 - protein, 16 aa, Mus sp.
ISVAVATPRGLVVPVI

SEQ ID NO: 8036 - protein, 15 aa, Mus sp.
DDIRSDWTNPEINKA

SEQ ID NO: 8037 - protein, 14 aa, Mus sp.
ISVAVATPRGLVVP

SEQ ID NO: 8038 - protein, 13 aa, Mus sp.
HDLDFRAPHVLVL

SEQ ID NO: 8039 - protein, 14 aa, Mus sp.
HVEGYEGSAASIST

SEQ ID NO: 8040 - protein, 16 aa, Mus sp.
KPPSYNVATTLPSYDE

SEQ ID NO: 8041 - protein, 16 aa, Mus sp.
IKVYWDAPSPAPDHIR

SEQ ID NO: 8042 - protein, 13 aa, Mus sp.
VIHFNNPKVQASL

SEQ ID NO: 8043 - protein, 16 aa, Mus sp.
AAELQTLAPAINWLPF

SEQ ID NO: 8044 - protein, 16 aa, Mus sp.
LNLDWQYPGSRGSPPK

SEQ ID NO: 8045 - protein, 14 aa, Mus sp.
LDYWTYPGSLTTPP

SEQ ID NO: 8046 - protein, 19 aa, Mus sp.
HSMRYFETAVSRPGLEEPR

SEQ ID NO: 8047 - protein, 12 aa, Mus sp.
GHKLGLGLEFQA

SEQ ID NO: 8048 - protein, 20 aa, Mus sp.
GADKTVKGPDGLTALEATDN

SEQ ID NO: 8049 - protein, 18 aa, Mus sp.
NPWGEVEWKGPWSDSSYE

SEQ ID NO: 8050 - protein, 17 aa, Mus sp.
EWKFTITPPSAQVVGVL

SEQ ID NO: 8051 - protein, 16 aa, Mus sp.
LPHFLHASPDVSEPIE

SEQ ID NO: 8052 - protein, 14 aa, Mus sp.
NVDPFKAVDTNRAS

SEQ ID NO: 8053 - protein, 15 aa, Mus sp.
SVGAWTGPMGNWAMF

SEQ ID NO: 8054 - protein, 15 aa, Mus sp.
ETVAYLQAHALTTEG

SEQ ID NO: 8055 - protein, 16 aa, Mus sp.
DGNHTLFHNPHVNPLP

SEQ ID NO: 8056 - protein, 15 aa, Mus sp.
EQEVLAPQVVLSLGG

SEQ ID NO: 8057 - protein, 18 aa, Mus sp.
FKKWVNTPFTASSIELVP

SEQ ID NO: 8058 - protein, 22 aa, Mus sp.
GSKVDFVAWATGEPNFANDDEN

SEQ ID NO: 8059 - protein, 14 aa, Mus sp.
EEIEVAPPKAHEVR

SEQ ID NO: 8060 - protein, 19 aa, Mus sp.
GLSGAEGARGPPGFKGHTG

SEQ ID NO: 8061 - protein, 19 aa, Mus sp.
HPDKGGSPYIAAKINEAKD

SEQ ID NO: 8062 - protein, 18 aa, Mus sp.
GPNFEYAEAPSRLSPDDA

SEQ ID NO: 8063 - protein, 18 aa, Mus sp.
VIEDRDHYIPNTLNPVFG

SEQ ID NO: 8064 - protein, 14 aa, Mus sp.
GDLSWHPALTTKSK

SEQ ID NO: 8065 - protein, 16 aa, Mus sp.
VDRVLKSPVASIVYEL

SEQ ID NO: 8066 - protein, 16 aa, Mus sp.
TPRDYYFALAHTVRDH

SEQ ID NO: 8067 - protein, 16 aa, Mus sp.
ESKIRYKTSEPVWEEN

SEQ ID NO: 8068 - protein, 16 aa, Mus sp.
EDPDGFSWPATLPSVY

SEQ ID NO: 8069 - protein, 17 aa, Listeria monocytogenes
GINQAYTGSTALSDGLN

SEQ ID NO: 8070 - protein, 17 aa, Mus sp.
KLLEAKGPVTDVAYSHD

SEQ ID NO: 8071 - protein, 14 aa, Mus sp.
TSSYYRGAHGIIVV

SEQ ID NO: 8072 - protein, 16 aa, Mus sp.
DDNVFVPPESLQEEDE

SEQ ID NO: 8073 - protein, 13 aa, Mus sp.
LFPQYTAPSILPS

SEQ ID NO: 8074 - protein, 15 aa, Mus sp.
LPPVSPPKAALSVDE

SEQ ID NO: 8075 - protein, 12 aa, Mus sp.
WTISPVPQSIVD

SEQ ID NO: 8076 - protein, 17 aa, Mus sp.
SLLLHWQPPLSHNGVLT

SEQ ID NO: 8077 - protein, 20 aa, Mus sp.
ITVKELFTTPVLRASVSSPF

SEQ ID NO: 8078 - protein, 15 aa, Mus sp.
EQLEWLSQRANALLA

SEQ ID NO: 8079 - protein, 14 aa, Mus sp.
KDLYYAAPLSIWWQ

SEQ ID NO: 8080 - protein, 15 aa, Mus sp.
LDSQYRASAPNSHVP

SEQ ID NO: 8081 - protein, 14 aa, Mus sp.
GTPEYLAPEIILSK

SEQ ID NO: 8082 - protein, 17 aa, Mus sp.
AKPSGYNPPISILGILE

SEQ ID NO: 8083 - protein, 16 aa, Mus sp.
VGETFHASQPSLTVDG

SEQ ID NO: 8084 - protein, 15 aa, Mus sp.
ALLLNAPVVSITQGR

SEQ ID NO: 8085 - protein, 17 aa, Mus sp.
LTGMAFRVPTPNVSVVD

SEQ ID NO: 8086 - protein, 25 aa, Mus sp.
FPGPNIGGDTHFDSAEPWTVQNEDL

SEQ ID NO: 8087 - protein, 16 aa, Mus sp.
AGGDARNKKLPNGPAF

SEQ ID NO: 8088 - protein, 16 aa, Mus sp.
KVSDYISPLLSFAAEH

SEQ ID NO: 8089 - protein, 16 aa, Mus sp.
IFNKFKFPAAVVVEDD

SEQ ID NO: 8090 - protein, 17 aa, Mus sp.
SGPKPFSAPKPQTSPSP

SEQ ID NO: 8091 - protein, 14 aa, Mus sp.
NERFRCPEAIFQPS

SEQ ID NO: 8092 - protein, 14 aa, Mus sp.
HDLDFRAPHVLVLG

SEQ ID NO: 8093 - protein, 20 aa, Mus sp.
KPVPAAPVPSPVAPAPVPSR

SEQ ID NO: 8094 - protein, 15 aa, Mus sp.
KRLEFEASQVLGTMD

SEQ ID NO: 8095 - protein, 16 aa, Mus sp.
TGMAFRVPTPNVSVVD

SEQ ID NO: 8096 - protein, 12 aa, Mus sp.
DIFIGPKAEEHR

SEQ ID NO: 8097 - protein, 16 aa, BOVIN
AVPDAAGPTPSAAGPP

SEQ ID NO: 8098 - protein, 25 aa, Mus sp.
KKHVPEEVLAVLEQEPIVLPAWDPM

SEQ ID NO: 8099 - protein, 18 aa, Mus sp.
ATPAPSAPAAASATSPSP

SEQ ID NO: 8100 - protein, 16 aa, Mus sp.
YTPYYVAPEVLGPEKY

SEQ ID NO: 8101 - protein, 15 aa, Mus sp.
INIYSASSVSEVNDG

SEQ ID NO: 8102 - protein, 17 aa, Mus sp.
GGKDFNMPLTISSLKDG

SEQ ID NO: 8103 - protein, 11 aa, Mus sp.
VATSIHEAVTK

SEQ ID NO: 8104 - protein, 16 aa, Mus sp.
EQFVYSSPHDNKSWEM

SEQ ID NO: 8105 - protein, 17 aa, Mus sp.
VPIYEGYALPHAILRLD

SEQ ID NO: 8106 - protein, 16 aa, Mus sp.
EFDYSGSQAIKALKEE

SEQ ID NO: 8107 - protein, 18 aa, Mus sp.
GDSNFGAPSASVAAAPAP

SEQ ID NO: 8108 - protein, 14 aa, Mus sp.
DKDSFSDPYAHVSF

SEQ ID NO: 8109 - protein, 13 aa, Mus sp.
ELDYYDSPSVNAR

SEQ ID NO: 8110 - protein, 12 aa, Mus sp.
FPYVTPAPHEPV

SEQ ID NO: 8111 - protein, 16 aa, Mus sp.
ITGVDFIGSTVGLAKV

SEQ ID NO: 8112 - protein, 8 aa, Mus sp.
HIYEFPQL

SEQ ID NO: 8113 - protein, 15 aa, Mus sp.
GYDPIISPEVAASFG

SEQ ID NO: 8114 - protein, 14 aa, Mus sp.
YDPIISPEVAASFG

SEQ ID NO: 8115 - protein, 16 aa, Mus sp.
LTVLEGDPYFTGKLQD

SEQ ID NO: 8116 - protein, 19 aa, Mus sp.
EDFLKKWETPSQNTAQLDQ

SEQ ID NO: 8117 - protein, 8 aa, Mus sp.
SVLQFLGL

SEQ ID NO: 8118 - protein, 10 aa, Mus sp.
YTPIPNGLYP

SEQ ID NO: 8119 - protein, 21 aa, Mus sp.
LPGNLDYWTYPGSLTTPPLLE

SEQ ID NO: 8120 - protein, 17 aa, Mus sp.
LLPEYANAEIVRTRDPE

SEQ ID NO: 8121 - protein, 12 aa, Mus sp.
VVPWSPPQSNWN

SEQ ID NO: 8122 - protein, 16 aa, Mus sp.
DIDSFVPSKAAPAAAA

SEQ ID NO: 8123 - protein, 18 aa, Mus sp.
KEDRRYNPPIIHQGFQDT

SEQ ID NO: 8124 - protein, 15 aa, Mus sp.
GSPNYAAPEVISGRL

SEQ ID NO: 8125 - protein, 16 aa, Mus sp.
YNPAQQILAYTGLCPP

SEQ ID NO: 8126 - protein, 30 aa, Mus sp.; identical to SEQ ID NO: 2463

SEQ ID NO: 8127 - protein, 11 aa, Mus sp.
KYSVWIGGSIL

SEQ ID NO: 8128 - protein, 13 aa, Mus sp.
KLPFAAAQIGNSF

SEQ ID NO: 8129 - protein, 17 aa, Mus sp.
KELEEQLGPVAEETRAR

SEQ ID NO: 8130 - protein, 18 aa, Mus sp.
NTHDLDFRAPHVLVLGSG

SEQ ID NO: 8131 - protein, 19 aa, Mus sp.
VDFVAWATGEPNFANDDEN

SEQ ID NO: 8132 - protein, 16 aa, Mus sp.
APDMVYLGSMTNFDVT

SEQ ID NO: 8133 - protein, 14 aa, Mus sp.
IQEPYTFPAILKSV

SEQ ID NO: 8134 - protein, 20 aa, Mus sp.
TPSPESPDQWSSSSPHSASD

SEQ ID NO: 8135 - protein, 16 aa, Mus sp.
LRQPYYATRVNAADIE

SEQ ID NO: 8136 - protein, 14 aa, Mus sp.
EMYKVHNPVPLIVG

SEQ ID NO: 8137 - protein, 15 aa, Mus sp.
PGKTSRLYQTFYLNT

SEQ ID NO: 8138 - protein, 19 aa, Mus sp.
VDGDVVHGFYNPAVSRIVE

SEQ ID NO: 8139 - protein, 18 aa, Mus sp.
DVVDRVLKSPVASIVYEL

SEQ ID NO: 8140 - protein, 16 aa, Mus sp.
SNLLLQSPGVLTAARE

SEQ ID NO: 8141 - protein, 17 aa, Mus sp.
LDLLQQRAPVPASTSVL

SEQ ID NO: 8142 - protein, 13 aa, Mus sp.
KFPDWSFPSAWVS

SEQ ID NO: 8143 - protein, 16 aa, Mus sp.
HADASFVAAIPSTQVV

SEQ ID NO: 8144 - protein, 15 aa, Mus sp.
SGKIEVEKPFAIAKE

SEQ ID NO: 8145 - protein, 18 aa, Mus sp.
LEDPDGFSWPATLPSVYK

SEQ ID NO: 8146 - protein, 15 aa, Mus sp.
TDKFWGPSGAESVIG

SEQ ID NO: 8147 - protein, 15 aa, Mus sp.
ELPDIAPPLVTPDEP

SEQ ID NO: 8148 - protein, 15 aa, Mus sp.
VIHFNNPKVQASLAA

SEQ ID NO: 8149 - protein, 16 aa, Mus sp.
TQVQWNDPGAQYSLVN

SEQ ID NO: 8150 - protein, 16 aa, Mus sp.
AVDALASSHPLSSPAD

SEQ ID NO: 8151 - protein, 16 aa, Mus sp.
VELPPSVSQAAKSPPG

SEQ ID NO: 8152 - protein, 15 aa, Mus sp.
KPSTFAYPAPLEVPK

SEQ ID NO: 8153 - protein, 13 aa, Mus sp.
AVDVFFPPEAQND

SEQ ID NO: 8154 - protein, 20 aa, Mus sp.
TEDGDMRLVNGASANEGRVE

SEQ ID NO: 8155 - protein, 13 aa, Mus sp.
VSSVEAPSVSPAR

SEQ ID NO: 8156 - protein, 14 aa, Mus sp.
LPNYSSPNALVLNT

SEQ ID NO: 8157 - protein, 26 aa, Mus sp.
FPGPNIGGDTHFDSAEPWTVQNEDLN

SEQ ID NO: 8158 - protein, 25 aa, Mus sp.
GPPIDIGRVTGPPIFNPVANEVYLN

SEQ ID NO: 8159 - protein, 16 aa, Mus sp.
APDAWDYSQGFVNEEM

SEQ ID NO: 8160 - protein, 25 aa, Mus sp.
GPGEPSPVSETVVTPEAAPEKNPVD

SEQ ID NO: 8161 - protein, 15 aa, Mus sp.
SEVYHEPHIADAWPQ

SEQ ID NO: 8162 - protein, 14 aa, Mus sp.
APQGSLGEYLFERL

SEQ ID NO: 8163 - protein, 16 aa, Mus sp.
DGYPVLYPTGWSSSDN

SEQ ID NO: 8164 - protein, 16 aa, Mus sp.
LVFDVTAPNTFKTLDS

SEQ ID NO: 8165 - protein, 22 aa, Mus sp.
YVDPTPDPNTAYASYPSASVEN

SEQ ID NO: 8166 - protein, 18 aa, Mus sp.
LPGNLDYWTYPGSLTTPP

SEQ ID NO: 8167 - protein, 16 aa, Listeria monocytogenes
WNEKYAQAYPNVSAKI

SEQ ID NO: 8168 - protein, 21 aa, Mus sp.
SEIDLKGIPVYRFVLPANAFA

SEQ ID NO: 8169 - protein, 27 aa, Mus sp.
FPGPNIGGDTHFDSAEPWTVQNEDLNG

SEQ ID NO: 8170 - protein, 16 aa, Mus sp.
EDYVELPPSVSQAATS

SEQ ID NO: 8171 - protein, 19 aa, Mus sp.
TNNQDFRGSAGAPSVENVK

SEQ ID NO: 8172 - protein, 17 aa, Mus sp.
WKALYTDPKSSETAAFV

SEQ ID NO: 8173 - protein, 15 aa, Mus sp.
VLVLDFVTPTPLGTR

SEQ ID NO: 8174 - protein, 18 aa, Mus sp.
DSRTNTAYVGSAILSEET

SEQ ID NO: 8175 - protein, 13 aa, Mus sp.
VRVDEYDYSKPIQ

SEQ ID NO: 8176 - protein, 18 aa, Mus sp.
DYVELPPSVSQAATSPPG

SEQ ID NO: 8177 - protein, 14 aa, Mus sp.
LPDYTSPVVLPYSR

SEQ ID NO: 8178 - protein, 16 aa, Mus sp.
VKFKSFCLKHSQNKPK

SEQ ID NO: 8179 - protein, 15 aa, Mus sp.
DFVAWATGEPNFAND

SEQ ID NO: 8180 - protein, 18 aa, Mus sp.
EPSPVSETVVTPEAAPEK

SEQ ID NO: 8181 - protein, 22 aa, Mus sp.
LPEEVGEYRQPSGGSVPVSPGP

SEQ ID NO: 8182 - protein, 15 aa, Mus sp.
YPNFAGPQAALANKS

SEQ ID NO: 8183 - protein, 25 aa, Mus sp.
ITGLDPAGPNFEYAEAPSRLSPDDA

SEQ ID NO: 8184 - protein, 15 aa, Mus sp.
ISKQEYDESGPSIVH

SEQ ID NO: 8185 - protein, 22 aa, Mus sp.
VDHNTRTTTWQRPTAEYVRNYE

SEQ ID NO: 8186 - protein, 17 aa, BOVIN
SVVVGPSVVAVPLPLHR

SEQ ID NO: 8187 - protein, 16 aa, Mus sp.
EWKDYKAGFGNLEREF

SEQ ID NO: 8188 - protein, 20 aa, Mus sp.
LLPLGEPTAVYKVRTPSAAT

SEQ ID NO: 8189 - protein, 34 aa, Mus sp.; identical to SEQ ID NO: 1398

SEQ ID NO: 8190 - protein, 18 aa, Mus sp.
GKKFTAPHILIATGGVPT

SEQ ID NO: 8191 - protein, 13 aa, Mus sp.
LRDWESPYSHDLD

SEQ ID NO: 8192 - protein, 12 aa, Mus sp.
RYNPPIIHQGFQ

SEQ ID NO: 8193 - protein, 15 aa, Mus sp.
LRDNYRFAHTNIESL

SEQ ID NO: 8194 - protein, 13 aa, Mus sp.
EVAFNGPKGGYVA

SEQ ID NO: 8195 - protein, 14 aa, Mus sp.
TNDQNQNGNHTLPQ

SEQ ID NO: 8196 - protein, 19 aa, Mus sp.
KGQDHVDFSQPEPHTVLFH

SEQ ID NO: 8197 - protein, 22 aa, BOVIN
AGPPVASVVVGPSVVAVPLPLH

SEQ ID NO: 8198 - protein, 16 aa, Mus sp.
VLFVYGGPQVQLVNNS

SEQ ID NO: 8199 - protein, 15 aa, Mus sp.
GELTYENVQVSPVPG

SEQ ID NO: 8200 - protein, 14 aa, Mus sp.
TNDRYVASLAARNK

SEQ ID NO: 8201 - protein, 22 aa, Mus sp.
TPPPPPPNEISPPHAVEEEEDD

SEQ ID NO: 8202 - protein, 12 aa, Mus sp.
IEGYVPSQADVA

SEQ ID NO: 8203 - protein, 16 aa, Mus sp.
NIPYFETSAKEAINVE

SEQ ID NO: 8204 - protein, 17 aa, Mus sp.
YVELPPSVSQAAKSPPG

SEQ ID NO: 8205 - protein, 15 aa, Mus sp.
EGDIFIGPKAEEHRG

SEQ ID NO: 8206 - protein, 14 aa, Mus sp.
LSYAVSWAKVSESG

SEQ ID NO: 8207 - protein, 12 aa, Mus sp.
KPFQNPVPNQSP

SEQ ID NO: 8208 - protein, 17 aa, Mus sp.
IPSPGLMVFPKPQTALE

SEQ ID NO: 8209 - protein, 15 aa, Mus sp.
TDLRFQSSAVMALQE

SEQ ID NO: 8210 - protein, 16 aa, Mus sp.
GTPGYVAPEVLAQKPY

SEQ ID NO: 8211 - protein, 18 aa, Mus sp.
GEQIYYAGPVNNPGLDVP

SEQ ID NO: 8212 - protein, 22 aa, Mus sp.
INPDEAVAYGAAVQAAILSGDK

SEQ ID NO: 8213 - protein, 16 aa, Mus sp.
STDYGNFLANEASPLT

SEQ ID NO: 8214 - protein, 17 aa, Mus sp.
HGLELEEPPLVLAAANV

SEQ ID NO: 8215 - protein, 14 aa, Mus sp.
LDQLFSGPLPGRLP

SEQ ID NO: 8216 - protein, 16 aa, Mus sp.
SVYTRYHCSLPVPEPS

SEQ ID NO: 8217 - protein, 16 aa, Mus sp.
APAAAEAPAAAEAPAA

SEQ ID NO: 8218 - protein, 12 aa, Mus sp.
KIVYEGPELNHA

SEQ ID NO: 8219 - protein, 15 aa, Mus sp.
STDYGNFLANEASPL

SEQ ID NO: 8220 - protein, 14 aa, Mus sp.
GKWKYEKPDGSPVF

SEQ ID NO: 8221 - protein, 15 aa, Mus sp.
YTIPFYTPIPNGLYP

SEQ ID NO: 8222 - protein, 19 aa, Mus sp.
SFSGALGVPSFVVPSSGPG

SEQ ID NO: 8223 - protein, 15 aa, Mus sp.
KSKYKASIAALEAKI

SEQ ID NO: 8224 - protein, 16 aa, Mus sp.
EPTGVYHQTTLHMALS

SEQ ID NO: 8225 - protein, 15 aa, Mus sp.
LPFGAYTNPFATPAQ

SEQ ID NO: 8226 - protein, 17 aa, Mus sp.
SMPDYKPSFPKWARQDF

SEQ ID NO: 8227 - protein, 14 aa, Mus sp.
EPYEVHNPVPLIVG

SEQ ID NO: 8228 - protein, 19 aa, Mus sp.
AAPAPAAAPAAAPAAAPEP

SEQ ID NO: 8229 - protein, 14 aa, Mus sp.
GPTYRGPVPWHTIN

SEQ ID NO: 8230 - protein, 16 aa, Mus sp.
GYPTAYPAAAPAYNPS

SEQ ID NO: 8231 - protein, 18 aa, Mus sp.
VSPTVHFTPAEISRSVFE

SEQ ID NO: 8232 - protein, 17 aa, Mus sp.
DTIEFRGPNGLLVYQGK

SEQ ID NO: 8233 - protein, 20 aa, Mus sp.
NQGTVIHFNNPKVQASLAAN

SEQ ID NO: 8234 - protein, 16 aa, Mus sp.
VGPDYAHAEARKSPAL

SEQ ID NO: 8235 - protein, 17 aa, Mus sp.
VPPPFAAAAINEAIDAE

SEQ ID NO: 8236 - protein, 19 aa, Mus sp.
TDDEKVRVSYYGPKTSPVQ

SEQ ID NO: 8237 - protein, 17 aa, Mus sp.
EYPDSWSTPHSYFSLKF

SEQ ID NO: 8238 - protein, 8 aa, Mus sp.
PKISTSLP

SEQ ID NO: 8239 - protein, 16 aa, Mus sp.
DRKIVYEGPELNHAFG

SEQ ID NO: 8240 - protein, 25 aa, Mus sp.
LSPDDADFVDVLHTFTRGSPGRSIG

SEQ ID NO: 8241 - protein, 16 aa, Mus sp.
IEFTFERSNTNPSVTV

SEQ ID NO: 8242 - protein, 15 aa, Mus sp.
GFPYEGPAPLEAIAN

SEQ ID NO: 8243 - protein, 17 aa, Mus sp.
IGGDPFAAPQVVPAFAS

SEQ ID NO: 8244 - protein, 16 aa, Mus sp.
EMNLMHAPQVADAILG

SEQ ID NO: 8245 - protein, 24 aa, Mus sp.
ITGLDPAGPNFEYAEAPSRLSPDD

SEQ ID NO: 8246 - protein, 19 aa, Mus sp.
KPADITDVVKPIALPTEEP

SEQ ID NO: 8247 - protein, 18 aa, Listeria monocytogenes
EILLQKPNGERLTSFITL

SEQ ID NO: 8248 - protein, 17 aa, Mus sp.
SDGYPVLYPTGWSSSDN

SEQ ID NO: 8249 - protein, 13 aa, Mus sp.
DQLFSGPLPGRLP

SEQ ID NO: 8250 - protein, 17 aa, Mus sp.
LSSEMNTSTVNSAREEL

SEQ ID NO: 8251 - protein, 19 aa, BOVIN
GPPVASVVVGPSVVAVPLP

SEQ ID NO: 8252 - protein, 22 aa, Listeria monocytogenes
RDNYLFQLYEATGTPIHPMSPF

SEQ ID NO: 8253 - protein, 14 aa, Mus sp.
WKALYTDPKSSETA

SEQ ID NO: 8254 - protein, 17 aa, Mus sp.
DVKKPAAAPAPAPAPAP

SEQ ID NO: 8255 - protein, 9 aa, Mus sp.
SPITVEWRA

SEQ ID NO: 8256 - protein, 9 aa, Mus sp.
GRDFYKILG

SEQ ID NO: 8257 - protein, 15 aa, Mus sp.
TKRYMAPEVLDDSIN

SEQ ID NO: 8258 - protein, 15 aa, Mus sp.
VELPPSVSQAATSPP

SEQ ID NO: 8259 - protein, 17 aa, Mus sp.
TGMAFRVPTPNVSVVDL

SEQ ID NO: 8260 - protein, 17 aa, Mus sp.
AEQEVLAPQVVLSLGGS

SEQ ID NO: 8261 - protein, 26 aa, Mus sp.
NPTVEVDLYTAKGLFRAAVPSGASTG

SEQ ID NO: 8262 - protein, 12 aa, Mus sp.
VFFPPEAQNDFP

SEQ ID NO: 8263 - protein, 12 aa, Mus sp.
IFYGASIASLSA

SEQ ID NO: 8264 - protein, 15 aa, Mus sp.
SFKDPKISTSLPVLD

SEQ ID NO: 8265 - protein, 17 aa, Mus sp.
TVPFWAHAGNAIPSADQ

SEQ ID NO: 8266 - protein, 16 aa, Mus sp.
FELKPRSPQVIPIEEF

SEQ ID NO: 8267 - protein, 13 aa, Mus sp.
DIFIGPKAEEHRG

SEQ ID NO: 8268 - protein, 20 aa, Mus sp.
LVTEDNVFEAPTLVKVFKQP

SEQ ID NO: 8269 - protein, 19 aa, Mus sp.
YPSQASIYSPPAAAAAAAA

SEQ ID NO: 8270 - protein, 17 aa, Mus sp.
LAVLEQEPIVLPAWDPM

SEQ ID NO: 8271 - protein, 21 aa, Mus sp.
LNGKLTGMAFRVPTPNVSVVD

SEQ ID NO: 8272 - protein, 18 aa, Mus sp.
FGNSEFDPPGPNVATTTV

SEQ ID NO: 8273 - protein, 14 aa, Mus sp.
DFVAWATGEPNFAN

SEQ ID NO: 8274 - protein, 21 aa, BOVIN
SVVVGPSVVAVPLPLHRAHYD

SEQ ID NO: 8275 - protein, 12 aa, Mus sp.
KLQMEAPHIIVG

SEQ ID NO: 8276 - protein, 14 aa, Mus sp.
KPVPAAPVPSPVAP

SEQ ID NO: 8277 - protein, 15 aa, Mus sp.
DVNTYNAAIAYTIVS

SEQ ID NO: 8278 - protein, 16 aa, Mus sp.
NINQWTASIVEQSITH

SEQ ID NO: 8279 - protein, 15 aa, Mus sp.
LDNYLTSPLPEEVDE

SEQ ID NO: 8280 - protein, 14 aa, Mus sp.
ASLGWIGSIVSTAL

SEQ ID NO: 8281 - protein, 13 aa, Mus sp.
VNSQYQEPDIIIH

SEQ ID NO: 8282 - protein, 14 aa, Mus sp.
AIVEYHGPGVDSIS

SEQ ID NO: 8283 - protein, 11 aa, Mus sp.
TPDYIAPEILQ

SEQ ID NO: 8284 - protein, 16 aa, Mus sp.
LIGRTWNDPSVQQDIK

SEQ ID NO: 8285 - protein, 11 aa, Mus sp.
GAWTGPMGNWA

SEQ ID NO: 8286 - protein, 18 aa, Mus sp.
YPPSGPTYRGPVPWHTIN

SEQ ID NO: 8287 - protein, 15 aa, Mus sp.
NINQWTASIVEQSIT

SEQ ID NO: 8288 - protein, 14 aa, Mus sp.
SVGAWTGPMGNWAM

SEQ ID NO: 8289 - protein, 15 aa, Mus sp.
GYAVYETPTAHNGAK

SEQ ID NO: 8290 - protein, 24 aa, Mus sp.
SPAPSTRVITNQYNSPTGLYSSEN

SEQ ID NO: 8291 - protein, 17 aa, Mus sp.
ARDNMFSGSKINYTENR

SEQ ID NO: 8292 - protein, 15 aa, Mus sp.
LHLRFSAPQIENEPE

SEQ ID NO: 8293 - protein, 19 aa, Mus sp.
NRDGDSYRSPWSNKYDPPL

SEQ ID NO: 8294 - protein, 17 aa, Mus sp.
DPTTAFQAPDVGQALLQ

SEQ ID NO: 8295 - protein, 14 aa, Mus sp.
KSLTIQPDPIVVPG

SEQ ID NO: 8296 - protein, 16 aa, Mus sp.
APINAFIGGLAAQEVM

SEQ ID NO: 8297 - protein, 15 aa, Mus sp.
TPDYIAPEILQGLKY

SEQ ID NO: 8298 - protein, 12 aa, Mus sp.
GERFEAPEALFQ

SEQ ID NO: 8299 - protein, 14 aa, Mus sp.
ALMYNTPRAATIIA

SEQ ID NO: 8300 - protein, 17 aa, Mus sp.
FPTLKFFPASADRTVID

SEQ ID NO: 8301 - protein, 17 aa, Mus sp.
DTNLNDLGPRALEIYRA

SEQ ID NO: 8302 - protein, 16 aa, Mus sp.
AKQIVWNGPVGVFEWE

SEQ ID NO: 8303 - protein, 16 aa, Mus sp.
VRVDEYDYSKPIQGQQ

SEQ ID NO: 8304 - protein, 21 aa, Mus sp.
NPEPPPPRSHYSNIEANESEE

SEQ ID NO: 8305 - protein, 15 aa, Mus sp.
EVSSVEAPSVSPARH

SEQ ID NO: 8306 - protein, 13 aa, Mus sp.
IRSDWTNPEINKA

SEQ ID NO: 8307 - protein, 12 aa, Mus sp.
IAWESPQGQVSR

SEQ ID NO: 8308 - protein, 17 aa, Mus sp.
LDKDSFSDPYAHVSFLH

SEQ ID NO: 8309 - protein, 12 aa, Mus sp.
SVFVAPAVTPVK

SEQ ID NO: 8310 - protein, 15 aa, Mus sp.
DIRWQQPSPSPTGPY

SEQ ID NO: 8311 - protein, 16 aa, Mus sp.
FVEEFIWPAVQSSALY

SEQ ID NO: 8312 - protein, 13 aa, Mus sp.
IVKYNASLVTPEM

SEQ ID NO: 8313 - protein, 14 aa, Mus sp.
TTVEYLAPWANQID

SEQ ID NO: 8314 - protein, 16 aa, Mus sp.
VRIDQYQGADAVGLEE

SEQ ID NO: 8315 - protein, 18 aa, Mus sp.
SLVLFCRVYRVWVLVVGG

SEQ ID NO: 8316 - protein, 16 aa, Mus sp.
REGSYEAAKILLDHFA

SEQ ID NO: 8317 - protein, 11 aa, Mus sp.
LKPEYVAPLVL

SEQ ID NO: 8318 - protein, 16 aa, Mus sp.
GNMHYDTPDIRRFDPV

SEQ ID NO: 8319 - protein, 17 aa, Mus sp.
LDLLDLAPEPRYAHIPV

SEQ ID NO: 8320 - protein, 12 aa, Mus sp.
MYLSPLQQAVSD

SEQ ID NO: 8321 - protein, 15 aa, Mus sp.
FEVQWQSAEPGSTPR

SEQ ID NO: 8322 - protein, 15 aa, Mus sp.
GIPVYRFVLPANAFA

SEQ ID NO: 8323 - protein, 14 aa, Mus sp.
DTIEFRGPNGLLVY

SEQ ID NO: 8324 - protein, 18 aa, Mus sp.
IPKVVKSPSSLPAKPLVP

SEQ ID NO: 8325 - protein, 15 aa, Mus sp.
NVQFSSPLPGEAVKD

SEQ ID NO: 8326 - protein, 22 aa, Mus sp.
DPTPDPNTAYASYPSASVENYQ

SEQ ID NO: 8327 - protein, 17 aa, Mus sp.
GDMPTKLRRLDVHANQE

SEQ ID NO: 8328 - protein, 13 aa, Mus sp.
FPIKWTAPEAINF

SEQ ID NO: 8329 - protein, 13 aa, Mus sp.
GKKFTAPHILIAT

SEQ ID NO: 8330 - protein, 21 aa, Mus sp.
LVTYVPVTTFKNLQTVNVDEN

SEQ ID NO: 8331 - protein, 18 aa, Mus sp.
GDLERFLSSAAAVSKEHP

SEQ ID NO: 8332 - protein, 9 aa, Mus sp.
ELFPVFTQL

SEQ ID NO: 8333 - protein, 14 aa, Mus sp.
VTRQTTQYPEANAL

SEQ ID NO: 8334 - protein, 15 aa, Mus sp.
LALMYNTPRAATIIA

SEQ ID NO: 8335 - protein, 16 aa, Mus sp.
APMYYRGAQAAIVVYD

SEQ ID NO: 8336 - protein, 16 aa, Mus sp.
VKDGYQMAQPVFAPKN

SEQ ID NO: 8337 - protein, 14 aa, Mus sp.
VEYHFLSPYVSPRE

SEQ ID NO: 8338 - protein, 17 aa, Mus sp.
FRLWDFRDPSIHSVNVF

SEQ ID NO: 8339 - protein, 19 aa, Mus sp.
APSNYLNNPYVRKALHIPE

SEQ ID NO: 8340 - protein, 15 aa, Mus sp.
KFTLQDSRTNTAYVG

SEQ ID NO: 8341 - protein, 17 aa, Mus sp.
EFPDNYNSPTPYKIQYN

SEQ ID NO: 8342 - protein, 16 aa, Mus sp.
TVPIYEGYALPHAILR

SEQ ID NO: 8343 - protein, 17 aa, Mus sp.
EIQPFHRAAAIQAISLD

SEQ ID NO: 8344 - protein, 15 aa, Mus sp.
GDTHFDSAEPWTVQN

SEQ ID NO: 8345 - protein, 17 aa, Mus sp.
SPGILQASPTPLLAAAA

SEQ ID NO: 8346 - protein, 20 aa, Mus sp.
APSEERVYMVGKANSVFEDL

SEQ ID NO: 8347 - protein, 17 aa, Mus sp.
GIYEYYEPRLSVLPSPV

SEQ ID NO: 8348 - protein, 14 aa, Mus sp.
YNEVHSPSVAVEMG

SEQ ID NO: 8349 - protein, 15 aa, Mus sp.
IGDSNFGAPSASVAA

SEQ ID NO: 8350 - protein, 12 aa, Mus sp.
VTPWKAPIVWEG

SEQ ID NO: 8351 - protein, 11 aa, Mus sp.
LEVVKKDYDAL

SEQ ID NO: 8352 - protein, 15 aa, Mus sp.
NVDPFKAVDTNRASM

SEQ ID NO: 8353 - protein, 18 aa, Mus sp.
EETAFQTPKPSQTPSVPP

SEQ ID NO: 8354 - protein, 17 aa, Mus sp.
VPDDLLYSFPVVIKNKT

SEQ ID NO: 8355 - protein, 15 aa, Mus sp.
EVLDYSTPTTNGTPE

SEQ ID NO: 8356 - protein, 12 aa, Mus sp.
DAEYWNSQPEIL

SEQ ID NO: 8357 - protein, 16 aa, Mus sp.
MYQMYGGPVVLVAHSM

SEQ ID NO: 8358 - protein, 15 aa, Mus sp.
GTPDYIAPEILQGLK

SEQ ID NO: 8359 - protein, 21 aa, Mus sp.
DVIIVDSGKIEVEKPFAIAKE

SEQ ID NO: 8360 - protein, 17 aa, Mus sp.
QPYSHSTAPSALPALDS

SEQ ID NO: 8361 - protein, 21 aa, Mus sp.
SNKIPEVDMARVVAPFMSNIP

SEQ ID NO: 8362 - protein, 17 aa, Mus sp.
LDDNVFVPPESLQEEDE

SEQ ID NO: 8363 - protein, 22 aa, Mus sp.
IEKDPAKGRIYQGTEADSIFSG

SEQ ID NO: 8364 - protein, 17 aa, Mus sp.
TAKGLFRAAVPSGASTG

SEQ ID NO: 8365 - protein, 13 aa, Mus sp.
RYMAPEVLESRMN

SEQ ID NO: 8366 - protein, 15 aa, BOVIN
VVVGPSVVAVPLPLH

SEQ ID NO: 8367 - protein, 14 aa, Mus sp.
LQPSGQLVSPRPAG

SEQ ID NO: 8368 - protein, 8 aa, Mus sp.
INFDFPKL

SEQ ID NO: 8369 - protein, 14 aa, Mus sp.
RDKWLAPDGLIFPD

SEQ ID NO: 8370 - protein, 15 aa, Mus sp.
YVPWNFHEPQPGQYE

SEQ ID NO: 8371 - protein, 15 aa, Mus sp.
GPPIFNPVANEVYLN

SEQ ID NO: 8372 - protein, 20 aa, Mus sp.
SEPTTLFKTASALRSSAPLN

SEQ ID NO: 8373 - protein, 12 aa, Mus sp.
ISWEPPAVSVRY

SEQ ID NO: 8374 - protein, 16 aa, Mus sp.
KGVKYEAPQTTDGLAG

SEQ ID NO: 8375 - protein, 16 aa, Mus sp.
APAQMAYPTAYPSFPG

SEQ ID NO: 8376 - protein, 18 aa, Mus sp.
FPGAQHYVGGNAALIGQR

SEQ ID NO: 8377 - protein, 15 aa, Mus sp.
YEERVLPSIVNEVLK

SEQ ID NO: 8378 - protein, 12 aa, Mus sp.
YKVHNPVPLIVG

SEQ ID NO: 8379 - protein, 17 aa, Mus sp.
DRKIVYEGPELNHAFGL

SEQ ID NO: 8380 - protein, 15 aa, Mus sp.
TMLSGKDTVQHWNWT

SEQ ID NO: 8381 - protein, 12 aa, Mus sp.
DPYDQPNAIYIE

SEQ ID NO: 8382 - protein, 12 aa, Mus sp.
VLAPQVVLSLGG

SEQ ID NO: 8383 - protein, 14 aa, Mus sp.
IDPYDQPNAIYIER

SEQ ID NO: 8384 - protein, 14 aa, Mus sp.
SRGEYSWAVAQGVK

SEQ ID NO: 8385 - protein, 22 aa, Mus sp.
RAPETRSQVTPSVPSEALDDST

SEQ ID NO: 8386 - protein, 18 aa, Mus sp.
DGDMRLVNGASANEGRVE

SEQ ID NO: 8387 - protein, 13 aa, Mus sp.
DVFLGPYVAVFDR

SEQ ID NO: 8388 - protein, 16 aa, Mus sp.
GTKRYMAPEVLDETIN

SEQ ID NO: 8389 - protein, 19 aa, Mus sp.
GGPGSAVSPYPSFNVSSDV

SEQ ID NO: 8390 - protein, 17 aa, Mus sp.
DPAEYDVSPETRRAQVE

SEQ ID NO: 8391 - protein, 19 aa, Mus sp.
GDLSWHPALTTKSKMRDPH

SEQ ID NO: 8392 - protein, 16 aa, Mus sp.
RDLKWGTPVPLEGFED

SEQ ID NO: 8393 - protein, 17 aa, Mus sp.
SKPSFHAPEPKPHYDPA

SEQ ID NO: 8394 - protein, 18 aa, Mus sp.
FPLKEDNWSLPNRAVEPQ

SEQ ID NO: 8395 - protein, 17 aa, Mus sp.
KIPPDVLQDMAVIAPML

SEQ ID NO: 8396 - protein, 19 aa, Mus sp.
GNRITPSYVAFTPEGERLI

SEQ ID NO: 8397 - protein, 14 aa, Mus sp.
IPEFQLPHLSHTIE

SEQ ID NO: 8398 - protein, 19 aa, Listeria monocytogenes
DDTTVKFTLPTVAPAFENT

SEQ ID NO: 8399 - protein, 17 aa, Mus sp.
TPVFVHAGPFANIAHGN

SEQ ID NO: 8400 - protein, 19 aa, Mus sp.
GPEVDVSLPKANIDVSGPK

SEQ ID NO: 8401 - protein, 14 aa, Mus sp.
FFWNVAPGAESAVA

SEQ ID NO: 8402 - protein, 15 aa, Mus sp.
KLQMEAPHIIVGTPG

SEQ ID NO: 8403 - protein, 13 aa, Mus sp.
TVEYLAPWANQID

SEQ ID NO: 8404 - protein, 23 aa, Mus sp.
IQEMEKEDRRYNPPIIHQGFQDT

SEQ ID NO: 8405 - protein, 14 aa, Mus sp.
RTWAWEAVEALESH

SEQ ID NO: 8406 - protein, 17 aa, Mus sp.
VRIDQYQGADAVGLEEK

SEQ ID NO: 8407 - protein, 15 aa, Mus sp.
APVPSPVAPAPVPSR

SEQ ID NO: 8408 - protein, 16 aa, Mus sp.
QLEALVGPEANVGPYG

SEQ ID NO: 8409 - protein, 14 aa, Mus sp.
VDLPNYSSPNALVL

SEQ ID NO: 8410 - protein, 18 aa, Mus sp.
DPAKGRIYQGTEADSIFS

SEQ ID NO: 8411 - protein, 14 aa, Mus sp.
VQTYVGAISNGSLP

SEQ ID NO: 8412 - protein, 13 aa, Mus sp.
RYMAPEVLDETIN

SEQ ID NO: 8413 - protein, 18 aa, Mus sp.
TSQELVRAPTAALSPEPQ

SEQ ID NO: 8414 - protein, 17 aa, Mus sp.
GALLLNAPVVSITQGRN

SEQ ID NO: 8415 - protein, 15 aa, Mus sp.
GDLEYQMSTTARAKR

SEQ ID NO: 8416 - protein, 19 aa, Mus sp.
GSGNSTGFGEHGSSSHPLP

SEQ ID NO: 8417 - protein, 19 aa, Mus sp.
DERFGVRFPAMSDAYDRDM

SEQ ID NO: 8418 - protein, 16 aa, Mus sp.
DPSAFAAAAPAAAATT

SEQ ID NO: 8419 - protein, 18 aa, Mus sp.
SQMAQYFEPLTLAAVGAA

SEQ ID NO: 8420 - protein, 17 aa, Mus sp.
GGYGTLQHGEDTVPQGP

SEQ ID NO: 8421 - protein, 13 aa, Mus sp.
KPFQNPVPNQSPS

SEQ ID NO: 8422 - protein, 16 aa, Mus sp.
TSSYYRGAHGIIVVYD

SEQ ID NO: 8423 - protein, 16 aa, Mus sp.
LGEFDTPEAIWSSEMR

SEQ ID NO: 8424 - protein, 18 aa, Mus sp.
MEKEDRRYNPPIIHQGFQ

SEQ ID NO: 8425 - protein, 15 aa, Mus sp.
GKPAQYIAVHVVPDQ

SEQ ID NO: 8426 - protein, 17 aa, Mus sp.
AFALQEQPVVNAVIDDA

SEQ ID NO: 8427 - protein, 15 aa, Mus sp.
NPEAMVAPSVLSNIQ

SEQ ID NO: 8428 - protein, 12 aa, Mus sp.
AGWFDQIAVKVA

SEQ ID NO: 8429 - protein, 17 aa, Mus sp.
AQRAGYKAAIVHNVDSD

SEQ ID NO: 8430 - protein, 16 aa, Mus sp.
DHVDFSQPEPHTVLFH

SEQ ID NO: 8431 - protein, 21 aa, Mus sp.
IDLKGIPVYRFVLPANAFASP

SEQ ID NO: 8432 - protein, 14 aa, Mus sp.
NQLEALVGPEANVG

SEQ ID NO: 8433 - protein, 16 aa, Mus sp.
TPVFVHAGPFANIAHG

SEQ ID NO: 8434 - protein, 21 aa, Mus sp.
AFLGGGAPGSRHPGGGDYEEL

SEQ ID NO: 8435 - protein, 14 aa, Mus sp.
EAGQSKGFGLICFF

SEQ ID NO: 8436 - protein, 15 aa, Mus sp.
EEEVEVFLPKFKLEE

SEQ ID NO: 8437 - protein, 16 aa, Mus sp.
DPDFLRTAVAQVIGDR

SEQ ID NO: 8438 - protein, 21 aa, Mus sp.
GDSVTTDHISPAGNIARNSPA

SEQ ID NO: 8439 - protein, 14 aa, Mus sp.
YTRYHCSLPVPEPS

SEQ ID NO: 8440 - protein, 22 aa, Mus sp.
VPPAGGGDPEAPAPAPAAERPP

SEQ ID NO: 8441 - protein, 18 aa, Mus sp.
DGIHHWTPPKGHVDPGEN

SEQ ID NO: 8442 - protein, 16 aa, Mus sp.
LGFPYEGPAPLEAIAN

SEQ ID NO: 8443 - protein, 16 aa, Mus sp.
NTAQYKCPVAMEEADD

SEQ ID NO: 8444 - protein, 20 aa, Mus sp.
APAATDEAAASAAPAASPEP

SEQ ID NO: 8445 - protein, 13 aa, Mus sp.
RRYNPPIIHQGFQ

SEQ ID NO: 8446 - protein, 13 aa, Mus sp.
SVGGNMTSMQWAA

SEQ ID NO: 8447 - protein, 15 aa, Mus sp.
VELPPSVSQAAKSPP

SEQ ID NO: 8448 - protein, 15 aa, Mus sp.
SKQEYDESGPSIVHR

SEQ ID NO: 8449 - protein, 16 aa, Mus sp.
WSDAAAPFAGLSTDQT

SEQ ID NO: 8450 - protein, 14 aa, Mus sp.
DGFSWPATLPSVYK

SEQ ID NO: 8451 - protein, 15 aa, Mus sp.
TIRYMAPEVLEGAVN

SEQ ID NO: 8452 - protein, 24 aa, Mus sp.
GPGEPSPVSETVVTPEAAPEKNPV

SEQ ID NO: 8453 - protein, 18 aa, Mus sp.
TPVFVHAGPFANIAHGNS

SEQ ID NO: 8454 - protein, 12 aa, Mus sp.
NSYPVYLMEQQN

SEQ ID NO: 8455 - protein, 16 aa, Mus sp.
HFPDYRAAEVRETLNQ

SEQ ID NO: 8456 - protein, 14 aa, Mus sp.
APTSALGPKASPAP

SEQ ID NO: 8457 - protein, 18 aa, Mus sp.
ADRFMDDIACMIGYRPCP

SEQ ID NO: 8458 - protein, 16 aa, Mus sp.
FSFGKINPHYTVKGLE

SEQ ID NO: 8459 - protein, 17 aa, Mus sp.
ITVKELFTTPVLRASVS

SEQ ID NO: 8460 - protein, 8 aa, Mus sp.
VNIEFKDL

SEQ ID NO: 8461 - protein, 9 aa, Mus sp.
YMIDNIILL

SEQ ID NO: 8462 - protein, 16 aa, Mus sp.
DLPTTFQGATASTSYG

SEQ ID NO: 8463 - protein, 18 aa, Mus sp.
GDTIEFRGPNGLLVYQGK

SEQ ID NO: 8464 - protein, 18 aa, Mus sp.
LQHGSLFLKTPKIVSSKD

SEQ ID NO: 8465 - protein, 18 aa, Mus sp.
FHKLSYLTFIPSDDDIYD

SEQ ID NO: 8466 - protein, 17 aa, Mus sp.
LPRSQYDYVLPQVSFTA

SEQ ID NO: 8467 - protein, 21 aa, Listeria monocytogenes
APGQETQHYYGLPVADSAIDR

SEQ ID NO: 8468 - protein, 17 aa, Mus sp.
MYQMYGGPVVLVAHSMG

SEQ ID NO: 8469 - protein, 18 aa, Mus sp.
ITGVDFIGSTVGLAKVSA

SEQ ID NO: 8470 - protein, 14 aa, Mus sp.
DIYVWRGAQATLSN

SEQ ID NO: 8471 - protein, 14 aa, Mus sp.
KFPDWSFPSAWVST

SEQ ID NO: 8472 - protein, 13 aa, Mus sp.
DNYRFAHTNIESL

SEQ ID NO: 8473 - protein, 17 aa, Mus sp.
AANVYTTVVAELVRGGQ

SEQ ID NO: 8474 - protein, 16 aa, Mus sp.
VNGKKFTAPHILIATG

SEQ ID NO: 8475 - protein, 14 aa, Mus sp.
SMIVNVSCTSACTD

SEQ ID NO: 8476 - protein, 15 aa, Mus sp.
KSIYRYDLASGATEQ

SEQ ID NO: 8477 - protein, 17 aa, Mus sp.
DPELPQFIQAKVNAINM

SEQ ID NO: 8478 - protein, 17 aa, Mus sp.
YGIPFAAPTALASRDGN

SEQ ID NO: 8479 - protein, 11 aa, Mus sp.
ANVGWNGSTFA

SEQ ID NO: 8480 - protein, 22 aa, Mus sp.
TPARAPETRSQVTPSVPSEALD

SEQ ID NO: 8481 - protein, 17 aa, Mus sp.
RDGDSYRSPWSNKYDPP

SEQ ID NO: 8482 - protein, 18 aa, Mus sp.
DGEEAGAYDGPRTADGIV

SEQ ID NO: 8483 - protein, 21 aa, Mus sp.
EMEKEDRRYNPPIIHQGFQDT

SEQ ID NO: 8484 - protein, 33 aa, Listeria monocytogenes; identical to SEQ ID NO: 210

SEQ ID NO: 8485 - protein, 17 aa, Mus sp.
AREGSYEAAKILLDHFA

SEQ ID NO: 8486 - protein, 14 aa, Mus sp.
QKTQYISPNLNPND

SEQ ID NO: 8487 - protein, 16 aa, Mus sp.
SVATNPIITPVAQENQ

SEQ ID NO: 8488 - protein, 15 aa, Mus sp.
KLLEAKGPVTDVAYS

SEQ ID NO: 8489 - protein, 14 aa, Mus sp.
NLDWQYPGSRGSPP

SEQ ID NO: 8490 - protein, 14 aa, Mus sp.
AYSSNQTHNLNPLL

SEQ ID NO: 8491 - protein, 16 aa, Mus sp.
GYAVYETPTAHNGAKN

SEQ ID NO: 8492 - protein, 16 aa, Mus sp.
GDGIEDFVSGVPRAAR

SEQ ID NO: 8493 - protein, 16 aa, Mus sp.
MPDMHFKTPKISMPDV

SEQ ID NO: 8494 - protein, 23 aa, Mus sp.
DKNGNPLNSVFVAPAVTPVKGVL

SEQ ID NO: 8495 - protein, 14 aa, Mus sp.
YVTQFHPPHIEIQM

SEQ ID NO: 8496 - protein, 19 aa, Mus sp.
MDEATRYLAPTILTDVDPN

SEQ ID NO: 8497 - protein, 17 aa, Mus sp.
WQGGVYASPSIAGSRPG

SEQ ID NO: 8498 - protein, 21 aa, Mus sp.
DDGHGGYKPFQNPVPNQSPSS

SEQ ID NO: 8499 - protein, 17 aa, Mus sp.
YPFDFQGAKIITGQEEG

SEQ ID NO: 8500 - protein, 14 aa, Mus sp.
EFDYSGSQAIKALK

SEQ ID NO: 8501 - protein, 17 aa, Mus sp.
GMAFRVPTPNVSVVDLT

SEQ ID NO: 8502 - protein, 15 aa, Mus sp.
TEDNVFEAPTLVKVF

SEQ ID NO: 8503 - protein, 13 aa, Mus sp.
ASFKDPKISTSLP

SEQ ID NO: 8504 - protein, 17 aa, Mus sp.
LGRPDAEYWNSQPEILE

SEQ ID NO: 8505 - protein, 15 aa, Mus sp.
WKFTITPPSAQVVGV

SEQ ID NO: 8506 - protein, 21 aa, Mus sp.
YPTPAYTIPFYTPIPNGLYPS

SEQ ID NO: 8507 - protein, 26 aa, Mus sp.
VIPELNGKLTGMAFRVPTPNVSVVDL

SEQ ID NO: 8508 - protein, 12 aa, Mus sp.
EFIWPAVQSSAL

SEQ ID NO: 8509 - protein, 13 aa, Mus sp.
APFDWEGAQASQA

SEQ ID NO: 8510 - protein, 16 aa, Mus sp.
TITVYSFPESVELRPL

SEQ ID NO: 8511 - protein, 15 aa, Mus sp.
VTDYYTLPIGIRTVA

SEQ ID NO: 8512 - protein, 16 aa, Mus sp.
LPKEWLTPAALQSSVS

SEQ ID NO: 8513 - protein, 14 aa, Mus sp.
DVYKYETSGIGEAR

SEQ ID NO: 8514 - protein, 14 aa, Mus sp.
SPDVVYSPETIEAR

SEQ ID NO: 8515 - protein, 15 aa, Mus sp.
IDIFSTPSSSNSTSK

SEQ ID NO: 8516 - protein, 14 aa, Mus sp.
TARYMAPEVLESRM

SEQ ID NO: 8517 - protein, 15 aa, Mus sp.
FYSKYSAPRLPAALE

SEQ ID NO: 8518 - protein, 19 aa, Mus sp.
KPKGQLPDYTSPVVLPYSR

SEQ ID NO: 8519 - protein, 12 aa, Mus sp.
IEVSSPITLQAL

SEQ ID NO: 8520 - protein, 12 aa, Mus sp.
VTQFHPPHIEIQ

SEQ ID NO: 8521 - protein, 8 aa, Mus sp.
VNFEFPEF

SEQ ID NO: 8522 - protein, 15 aa, Mus sp.
KQIVWNGPVGVFEWE

SEQ ID NO: 8523 - protein, 13 aa, Mus sp.
YQMYGGPVVLVAH

SEQ ID NO: 8524 - protein, 18 aa, Mus sp.
GPGSAVSPYPSFNVSSDV

SEQ ID NO: 8525 - protein, 15 aa, Mus sp.
GQLPDYTSPVVLPYS

SEQ ID NO: 8526 - protein, 16 aa, Mus sp.
DVSAYIPTNVISITDG

SEQ ID NO: 8527 - protein, 17 aa, Mus sp.
MKIYYFAAVAHLHMGKQ

SEQ ID NO: 8528 - protein, 15 aa, Mus sp.
DRQVWSGSKAAGAPP

SEQ ID NO: 8529 - protein, 17 aa, Mus sp.
SPCANDVALIGFMMKPS

SEQ ID NO: 8530 - protein, 16 aa, Mus sp.
DNMFSGSKINYTENRA

SEQ ID NO: 8531 - protein, 15 aa, Mus sp.
KGPAFVNPLIPENKE

SEQ ID NO: 8532 - protein, 24 aa, Mus sp.
KPTVTVVSPLPNDSINPQPSPDGL

SEQ ID NO: 8533 - protein, 20 aa, Mus sp.
VPPTPQPVAPTPSAAPAGPK

SEQ ID NO: 8534 - protein, 14 aa, Mus sp.
MDGEWEAPQIANPK

SEQ ID NO: 8535 - protein, 18 aa, Listeria monocytogenes
EAKELVDNAPKALKEGIA

SEQ ID NO: 8536 - protein, 15 aa, Mus sp.
RSQVTPSVPSEALDD

SEQ ID NO: 8537 - protein, 19 aa, Listeria monocytogenes
GTKEKVVATPVSNVSTSSA

SEQ ID NO: 8538 - protein, 17 aa, Mus sp.
STQLIRNGDWTFQVLVM

SEQ ID NO: 8539 - protein, 16 aa, Mus sp.
VVLYHRSPTANENQNL

SEQ ID NO: 8540 - protein, 17 aa, Mus sp.
FPKPPSYNVATTLPSYD

SEQ ID NO: 8541 - protein, 16 aa, Mus sp.
MPDMHFKAPKISMPDV

SEQ ID NO: 8542 - protein, 16 aa, Mus sp.
EPPSDLDFFSPRPVPA

SEQ ID NO: 8543 - protein, 12 aa, Mus sp.
DNYRFAHTNIES

SEQ ID NO: 8544 - protein, 16 aa, Mus sp.
TETQEKNPLPSKETIE

SEQ ID NO: 8545 - protein, 18 aa, Mus sp.
TPDPNTAYASYPSASVEN

SEQ ID NO: 8546 - protein, 14 aa, Mus sp.
DEAYVQPEPLGVVL

SEQ ID NO: 8547 - protein, 16 aa, Mus sp.
KELEEQLGPVAEETRA

SEQ ID NO: 8548 - protein, 15 aa, Mus sp.
KQIDYTVPTVIAEEM

SEQ ID NO: 8549 - protein, 16 aa, Mus sp.
GVPTVPLLPPQVNQSL

SEQ ID NO: 8550 - protein, 18 aa, Mus sp.
EETELDQLFSGPLPGRLP

SEQ ID NO: 8551 - protein, 16 aa, Mus sp.
LLLHWQPPLSHNGVLT

SEQ ID NO: 8552 - protein, 22 aa, Mus sp.
GADELLKRVYGSFLVNPEPGYN

SEQ ID NO: 8553 - protein, 16 aa, Mus sp.
KKVIYSQPSTRSEGEF

SEQ ID NO: 8554 - protein, 15 aa, Mus sp.
ASVATNPIITPVAQE

SEQ ID NO: 8555 - protein, 17 aa, Mus sp.
GDTHFDSAEPWTVQNED

SEQ ID NO: 8556 - protein, 12 aa, Mus sp.
LFHNPHVNPLPT

SEQ ID NO: 8557 - protein, 17 aa, Mus sp.
DSPDVVYSPETIEARYE

SEQ ID NO: 8558 - protein, 22 aa, Mus sp.
DEDLETKKFRFEEPVVLPDLSD

SEQ ID NO: 8559 - protein, 8 aa, Mus sp.
SSFVFLNL

SEQ ID NO: 8560 - protein, 13 aa, Mus sp.
INYQPPTVVPGGD

SEQ ID NO: 8561 - protein, 29 aa, Mus sp.
QPGATTVQEQLRQLFERDWSSHYAMDLDR

SEQ ID NO: 8562 - protein, 17 aa, Mus sp.
VPPTPQPVAPTPSAAPA

SEQ ID NO: 8563 - protein, 16 aa, Mus sp.
AINDYKGAVIVVSHDA

SEQ ID NO: 8564 - protein, 15 aa, Mus sp.
NYEYYASHVPESVKN

SEQ ID NO: 8565 - protein, 19 aa, Mus sp.
HDGDSVVFAGPAGNSVETR

SEQ ID NO: 8566 - protein, 17 aa, Mus sp.
TKNLDYVATSIHEAVTK

SEQ ID NO: 8567 - protein, 20 aa, Mus sp.
WGIDPYDQPNAIYIERHEPF

SEQ ID NO: 8568 - protein, 13 aa, Mus sp.
RVPTPNVSVVDLT

SEQ ID NO: 8569 - protein, 14 aa, Mus sp.
PPSYYTQPVPVPNA

SEQ ID NO: 8570 - protein, 18 aa, Mus sp.
GPRAEEYEFLTPMEEAPK

SEQ ID NO: 8571 - protein, 16 aa, Mus sp.
KPIIWAEPGSVIAAYT

SEQ ID NO: 8572 - protein, 20 aa, Mus sp.
SPTSPSYSPTSPNYSPTSPN

SEQ ID NO: 8573 - protein, 17 aa, Mus sp.
KGPAFVNPLIPENKEEE

SEQ ID NO: 8574 - protein, 15 aa, Mus sp.
ELEEQLGPVAEETRA

SEQ ID NO: 8575 - protein, 15 aa, Mus sp.
VAVNWYAPLVAPISK

SEQ ID NO: 8576 - protein, 15 aa, Mus sp.
ADDIVGPVTHEIFEN

SEQ ID NO: 8577 - protein, 15 aa, Mus sp.
NLDYWTYPGSLTTPP

SEQ ID NO: 8578 - protein, 8 aa, Mus sp.
SNYVFVFL

SEQ ID NO: 8579 - protein, 15 aa, Mus sp.
GSFVYKGGKIYKVPS

SEQ ID NO: 8580 - protein, 13 aa, Mus sp.
FVAPAVTPVKGVL

SEQ ID NO: 8581 - protein, 15 aa, Mus sp.
GGQVYAFPSSQSVTE

SEQ ID NO: 8582 - protein, 13 aa, Mus sp.
GGYVAPKAVWLPA

SEQ ID NO: 8583 - protein, 15 aa, Mus sp.
MFETFNTPAMYVAIQ

SEQ ID NO: 8584 - protein, 23 aa, Mus sp.
DVDFEGVKKKAGYITPVPGGVGP

SEQ ID NO: 8585 - protein, 15 aa, Mus sp.
LENPHQPASLEATDS

SEQ ID NO: 8586 - protein, 16 aa, Mus sp.
LPPHVYSTPQPSLPPV

SEQ ID NO: 8587 - protein, 20 aa, Mus sp.
APISSHTAPRPNPTPALPQP

SEQ ID NO: 8588 - protein, 16 aa, Mus sp.
VTVVSPLPNDSINPQP

SEQ ID NO: 8589 - protein, 14 aa, Mus sp.
EQEVLAPQVVLSLG

SEQ ID NO: 8590 - protein, 14 aa, Mus sp.
AYNFDETKDLDLDD

SEQ ID NO: 8591 - protein, 17 aa, Mus sp.
EPIKSFEAPATINSASL

SEQ ID NO: 8592 - protein, 15 aa, Mus sp.
QSPYINPIIPFTGPI

SEQ ID NO: 8593 - protein, 15 aa, Mus sp.
NFPLKPGIPLPSPED

SEQ ID NO: 8594 - protein, 16 aa, Mus sp.
APTTAYKKTTPIEAAS

SEQ ID NO: 8595 - protein, 17 aa, Mus sp.
GDSNFGAPSASVAAAPA

SEQ ID NO: 8596 - protein, 17 aa, Mus sp.
GENPIYKSAVTTVVNPK

SEQ ID NO: 8597 - protein, 11 aa, Mus sp.
EGYALPHAILR

SEQ ID NO: 8598 - protein, 14 aa, Mus sp.
TPEYLAPEIILSKG

SEQ ID NO: 8599 - protein, 16 aa, Mus sp.
ASLELLEGKVLPGVDA

SEQ ID NO: 8600 - protein, 13 aa, Mus sp.
LVEYEASAAGLIR

SEQ ID NO: 8601 - protein, 16 aa, Mus sp.
GMAFRVPTPNVSVVDL

SEQ ID NO: 8602 - protein, 17 aa, Mus sp.
LPNVQVEGPTPNRPRKQ

SEQ ID NO: 8603 - protein, 15 aa, Mus sp.
ITYSYAGARAPMGQG

SEQ ID NO: 8604 - protein, 16 aa, Mus sp.
RNRYWGTPIPLWVSED

SEQ ID NO: 8605 - protein, 15 aa, BOVIN
SVVVGPSVVAVPLPL

SEQ ID NO: 8606 - protein, 16 aa, Mus sp.
GNLDYWTYPGSLTTPP

SEQ ID NO: 8607 - protein, 16 aa, Mus sp.
VGPVPWLGPQTDEAIK

SEQ ID NO: 8608 - protein, 14 aa, Mus sp.
GEFDYSGSQAIKAL

SEQ ID NO: 8609 - protein, 14 aa, Mus sp.
EDNVFEAPTLVKVF

SEQ ID NO: 8610 - protein, 19 aa, Listeria monocytogenes
TVRAKSKTYPVYINEFALE

SEQ ID NO: 8611 - protein, 15 aa, Mus sp.
EEDWTISPVPQSIVD

SEQ ID NO: 8612 - protein, 15 aa, Mus sp.
LRLQVESPQVHWEPT

SEQ ID NO: 8613 - protein, 15 aa, Mus sp.
LSLKYHFVTPLTSMV

SEQ ID NO: 8614 - protein, 15 aa, Listeria monocytogenes
ERWNEKYAQAYPNVS

SEQ ID NO: 8615 - protein, 16 aa, Mus sp.
VDVFYSSGIPATARPY

SEQ ID NO: 8616 - protein, 15 aa, Mus sp.
EVNSQYQEPDIIIHF

SEQ ID NO: 8617 - protein, 21 aa, Mus sp.
QDPEDHTVSFVQPNGAIFEPS

SEQ ID NO: 8618 - protein, 16 aa, Mus sp.
VPLPGMKWVDNHKGVF

SEQ ID NO: 8619 - protein, 14 aa, Mus sp.
VATENGYSYPVVSY

SEQ ID NO: 8620 - protein, 19 aa, Mus sp.
DSVTTDHISPAGNIARNSP

SEQ ID NO: 8621 - protein, 15 aa, Mus sp.
GVLLPFFDPDTNIVY

SEQ ID NO: 8622 - protein, 14 aa, Mus sp.
EVQWQSAEPGSTPR

SEQ ID NO: 8623 - protein, 13 aa, Mus sp.
KSKYKASIAALEA

SEQ ID NO: 8624 - protein, 16 aa, Mus sp.
EELYMPPLVIKVIDHR

SEQ ID NO: 8625 - protein, 15 aa, Mus sp.
IPKLVYHKNIPEWDH

SEQ ID NO: 8626 - protein, 16 aa, Mus sp.
LPKPIIWAEPGSVIAA

SEQ ID NO: 8627 - protein, 18 aa, Mus sp.
LNVLRVINEPTAAALAYG

SEQ ID NO: 8628 - protein, 15 aa, Mus sp.
GDSYRSPWSNKYDPP

SEQ ID NO: 8629 - protein, 15 aa, Mus sp.
IGRTWNDPSVQQDIK

SEQ ID NO: 8630 - protein, 18 aa, Mus sp.
DPDGFSWPATLPSVYKQP

SEQ ID NO: 8631 - protein, 13 aa, Mus sp.
DYFKGAIPIRKLV

SEQ ID NO: 8632 - protein, 14 aa, Mus sp.
RQNFTEPTAIQAQG

SEQ ID NO: 8633 - protein, 18 aa, Mus sp.
VLITDKFWGPSGAESVIG

SEQ ID NO: 8634 - protein, 16 aa, Mus sp.
KVNAVFSPKAASSPED

SEQ ID NO: 8635 - protein, 15 aa, Mus sp.
DHVDFSQPEPHTVLF

SEQ ID NO: 8636 - protein, 27 aa, Mus sp.
DDIEADHVGTYGISVYQSPGDIGQYTF

SEQ ID NO: 8637 - protein, 17 aa, Mus sp.
GDGRNYLLAFQKGIRNK

SEQ ID NO: 8638 - protein, 14 aa, Mus sp.
VNGKKFTAPHILIA

SEQ ID NO: 8639 - protein, 20 aa, Mus sp.
NGKLTGMAFRVPTPNVSVVD

SEQ ID NO: 8640 - protein, 15 aa, Mus sp.
SIASFKDPKISTSLP

SEQ ID NO: 8641 - protein, 13 aa, Mus sp.
RYMAPEVLDEHIR

SEQ ID NO: 8642 - protein, 16 aa, Mus sp.
EVAFNGPKGGYVALDD

SEQ ID NO: 8643 - protein, 15 aa, Mus sp.
AVKSKYKASIAALEA

SEQ ID NO: 8644 - protein, 20 aa, Mus sp.
GPHSMRYFETAVSRPGLEEP

SEQ ID NO: 8645 - protein, 15 aa, Mus sp.
SKEFEFIESQTSSHR

SEQ ID NO: 8646 - protein, 14 aa, Mus sp.
SPTYTPSSPSYSPS

SEQ ID NO: 8647 - protein, 14 aa, Mus sp.
GDSNFGAPSASVAA

SEQ ID NO: 8648 - protein, 16 aa, Mus sp.
ITPSYVAFTPEGERLI

SEQ ID NO: 8649 - protein, 14 aa, Mus sp.
QIDYTVPTVIAEEM

SEQ ID NO: 8650 - protein, 16 aa, Mus sp.
GQLPDYTSPVVLPYSR

SEQ ID NO: 8651 - protein, 15 aa, Mus sp.
FPIKWTAPEAINFGS

SEQ ID NO: 8652 - protein, 14 aa, Mus sp.
NLDYVATSIHEAVT

SEQ ID NO: 8653 - protein, 27 aa, Mus sp.
APTPSTPAPTPAATPAASPAPVSSDPA

SEQ ID NO: 8654 - protein, 20 aa, Mus sp.
DGEEAGAYDGPRTADGIVSH

SEQ ID NO: 8655 - protein, 14 aa, Mus sp.
QIYYAGPVNNPGLD

SEQ ID NO: 8656 - protein, 16 aa, Mus sp.
GTPDYIAPEILQGLKY

SEQ ID NO: 8657 - protein, 13 aa, Mus sp.
LPQDPTFHTPLDL

SEQ ID NO: 8658 - protein, 18 aa, Mus sp.
MKNVTELNEPLSNEERNL

SEQ ID NO: 8659 - protein, 16 aa, Mus sp.
DVQLVESGGGLVQPGG

SEQ ID NO: 8660 - protein, 13 aa, Mus sp.
SVSYLRECAKAND

SEQ ID NO: 8661 - protein, 18 aa, Mus sp.
VDVFYSSGIPATARPYRP

SEQ ID NO: 8662 - protein, 19 aa, Mus sp.
YPRDISNYGFPRSVQAIDA

SEQ ID NO: 8663 - protein, 21 aa, Mus sp.
VLITDKFWGPSGAESVIGGVH

SEQ ID NO: 8664 - protein, 16 aa, Mus sp.
KTPEIVAPESAHAAFD

SEQ ID NO: 8665 - protein, 16 aa, Mus sp.
TVIHFNNPKVQASLAA

SEQ ID NO: 8666 - protein, 20 aa, Mus sp.
VGAGHFRSPHTTEVVGGAPQ

SEQ ID NO: 8667 - protein, 12 aa, Mus sp.
VFVAPAVTPVKG

SEQ ID NO: 8668 - protein, 14 aa, Mus sp.
GAPFDWEGAQASQA

SEQ ID NO: 8669 - protein, 24 aa, Mus sp.
APAAPAAAEPQAEAPAAAASSEQS

SEQ ID NO: 8670 - protein, 16 aa, Mus sp.
NPTDEYLDAMMNEAPG

SEQ ID NO: 8671 - protein, 14 aa, Mus sp.
FEYAEAPSRLSPDD

SEQ ID NO: 8672 - protein, 16 aa, Mus sp.
VPWNFHEPQPGQYEFS

SEQ ID NO: 8673 - protein, 16 aa, Mus sp.
DGELTYENVQVSPVPG

SEQ ID NO: 8674 - protein, 18 aa, Mus sp.
TPAAPTSALGPKASPAPS

SEQ ID NO: 8675 - protein, 13 aa, Mus sp.
IPYQGPSSDYVVV

SEQ ID NO: 8676 - protein, 19 aa, Mus sp.
GLNVLRIINEPTAAAIAYG

SEQ ID NO: 8677 - protein, 14 aa, Mus sp.
TNTAYVGSAILSEE

SEQ ID NO: 8678 - protein, 19 aa, Mus sp.
APMPPIIHAPRINVVPMPP

SEQ ID NO: 8679 - protein, 13 aa, Mus sp.
ALVYTSPVIPELK

SEQ ID NO: 8680 - protein, 18 aa, Mus sp.
GNMHYDTPDIRRFDPVPA

SEQ ID NO: 8681 - protein, 17 aa, Mus sp.
YAKVELVPPTPAEIPTA

SEQ ID NO: 8682 - protein, 14 aa, Mus sp.
LPNVQVEGPTPNRP

SEQ ID NO: 8683 - protein, 14 aa, Mus sp.
LAWNAPAVLQKPYN

SEQ ID NO: 8684 - protein, 16 aa, Mus sp.
EDRRYNPPIIHQGFQD

SEQ ID NO: 8685 - protein, 15 aa, Mus sp.
EQFVYSSPHDNKSWE

SEQ ID NO: 8686 - protein, 14 aa, Mus sp.
PSYYTQPVPVPNAN

SEQ ID NO: 8687 - protein, 18 aa, Mus sp.
FNNQAYHSPATALAIVDN

SEQ ID NO: 8688 - protein, 18 aa, Mus sp.
GELTYENVQVSPVPGGPP

SEQ ID NO: 8689 - protein, 18 aa, Mus sp.
EDPDGFSWPATLPSVYKQ

SEQ ID NO: 8690 - protein, 13 aa, Mus sp.
RYMAPEVLEGAIN

SEQ ID NO: 8691 - protein, 19 aa, Mus sp.
SELERESKVVVPPLPGKAF

SEQ ID NO: 8692 - protein, 20 aa, Mus sp.
YPNPTLDHYKEPSAIFQLPY

SEQ ID NO: 8693 - protein, 16 aa, Mus sp.
SQELVRAPTAALSPEP

SEQ ID NO: 8694 - protein, 15 aa, Mus sp.
SPPPGGYGQPSVLPG

SEQ ID NO: 8695 - protein, 16 aa, Mus sp.
ENPIYKSAVTTVVNPK

SEQ ID NO: 8696 - protein, 18 aa, Mus sp.
DGVPVPGSPFPLEAVAPT

SEQ ID NO: 8697 - protein, 15 aa, Mus sp.
VDFDIAGPSIRGALV

SEQ ID NO: 8698 - protein, 19 aa, Mus sp.
TPAYTIPFYTPIPNGLYPS

SEQ ID NO: 8699 - protein, 18 aa, Mus sp.
EAIETIVAAMSNLVPPVE

SEQ ID NO: 8700 - protein, 16 aa, Mus sp.
SDPKPYSPKLSVIPTS

SEQ ID NO: 8701 - protein, 13 aa, Mus sp.
DPAWEAPEGVPID

SEQ ID NO: 8702 - protein, 20 aa, Mus sp.
SPESPDQWSSSSPHSASDWS

SEQ ID NO: 8703 - protein, 16 aa, Mus sp.
DPTTAFQAPDVGQALL

SEQ ID NO: 8704 - protein, 14 aa, Mus sp.
YKPFQNPVPNQSPS

SEQ ID NO: 8705 - protein, 13 aa, Mus sp.
RDYVPPTANLDQK

SEQ ID NO: 8706 - protein, 11 aa, Mus sp.
TIWVSPSPILE

SEQ ID NO: 8707 - protein, 19 aa, Mus sp.
ITDKFWGPSGAESVIGGVH

SEQ ID NO: 8708 - protein, 18 aa, Mus sp.
VPSVIYTHPEVAWVGKSE

SEQ ID NO: 8709 - protein, 12 aa, Mus sp.
DEATRYLAPTIL

SEQ ID NO: 8710 - protein, 14 aa, Mus sp.
AQTAYSANPASQAF

SEQ ID NO: 8711 - protein, 14 aa, Mus sp.
GTPEFLAPEVLTDT

SEQ ID NO: 8712 - protein, 18 aa, Mus sp.
YKKELEEQLGPVAEETRA

SEQ ID NO: 8713 - protein, 23 aa, Mus sp.
APTPSTPAPTPAATPAASPAPVS

SEQ ID NO: 8714 - protein, 19 aa, Mus sp.
TPSAAYLWVGAGASEAEKT

SEQ ID NO: 8715 - protein, 14 aa, Mus sp.
VIYTHPEVAWVGKS

SEQ ID NO: 8716 - protein, 16 aa, Mus sp.
GPVTPLSPSVLPSLPQ

SEQ ID NO: 8717 - protein, 16 aa, Mus sp.
NLRKMGAPEAGMAEYL

SEQ ID NO: 8718 - protein, 13 aa, Mus sp.
VAYEAPSLATGYG

SEQ ID NO: 8719 - protein, 15 aa, Mus sp.
RAAFYHQPWAQEAVG

SEQ ID NO: 8720 - protein, 23 aa, Mus sp.
KPFPWGDGNHTLFHNPHVNPLPT

SEQ ID NO: 8721 - protein, 18 aa, Mus sp.
GRADFREPNAQVSRPIPD

SEQ ID NO: 8722 - protein, 15 aa, Mus sp.
EELYMPPLVIKVIDH

SEQ ID NO: 8723 - protein, 17 aa, Mus sp.
LPFGAYTNPFATPAQAQ

SEQ ID NO: 8724 - protein, 16 aa, Mus sp.
EVLDYSTPTTNGTPEA

SEQ ID NO: 8725 - protein, 22 aa, Mus sp.
LDPAGPNFEYAEAPSRLSPDDA

SEQ ID NO: 8726 - protein, 26 aa, Mus sp.
KDAGTIAGLNVLRIINEPTAAAIAYG

SEQ ID NO: 8727 - protein, 16 aa, Mus sp.
MDLDIFNLPNVEISKD

SEQ ID NO: 8728 - protein, 17 aa, Mus sp.
KEIEVDSSPSVLEILDT

SEQ ID NO: 8729 - protein, 17 aa, Mus sp.
PLKEDNWSLPNRAVEPQ

SEQ ID NO: 8730 - protein, 12 aa, Mus sp.
LDYYDSPSVNAR

SEQ ID NO: 8731 - protein, 18 aa, Mus sp.
EDRRYNPPIIHQGFQDTS

SEQ ID NO: 8732 - protein, 17 aa, Mus sp.
DVPFTLAPHVLAAQGTI

SEQ ID NO: 8733 - protein, 15 aa, Mus sp.
LEEQLGPVAEETRAR

SEQ ID NO: 8734 - protein, 14 aa, Mus sp.
EPSVFNGPEVTMLK

SEQ ID NO: 8735 - protein, 19 aa, Mus sp.
VTEDNVFEAPTLVKVFKQP

SEQ ID NO: 8736 - protein, 15 aa, Mus sp.
LPETFRRPQIDPAVE

SEQ ID NO: 8737 - protein, 16 aa, Mus sp.
VPSVIYTHPEVAWVGK

SEQ ID NO: 8738 - protein, 15 aa, Mus sp.
VVFEWKDPFIQKVQD

SEQ ID NO: 8739 - protein, 15 aa, Mus sp.
GMAFRVPTPNVSVVD

SEQ ID NO: 8740 - protein, 19 aa, Mus sp.
EGNMHYDTPDIRRFDPVPA

SEQ ID NO: 8741 - protein, 19 aa, Mus sp.
EKEDRRYNPPIIHQGFQDT

SEQ ID NO: 8742 - protein, 14 aa, Mus sp.
GYKPFQNPVPNQSP

SEQ ID NO: 8743 - protein, 17 aa, Mus sp.
NPTDEYLDAMMNEAPGP

SEQ ID NO: 8744 - protein, 17 aa, Mus sp.
AGEFDYSGSQAIKALKE

SEQ ID NO: 8745 - protein, 23 aa, Mus sp.
YPPPYPPAAFQGPSDHAAYPIPQ

SEQ ID NO: 8746 - protein, 13 aa, Mus sp.
DAFVLKTPSAAYL

SEQ ID NO: 8747 - protein, 17 aa, Mus sp.
HNLFEDNMALPSESVSS

SEQ ID NO: 8748 - protein, 14 aa, Mus sp.
VTTDHISPAGNIAR

SEQ ID NO: 8749 - protein, 13 aa, Mus sp.
TARYMAPEVLESR

SEQ ID NO: 8750 - protein, 14 aa, Mus sp.
DIDSFVPSKAAPAA

SEQ ID NO: 8751 - protein, 19 aa, Mus sp.
HPPQEATNSPKPQPSYEEL

SEQ ID NO: 8752 - protein, 18 aa, Mus sp.
RPVQFPYVTPAPHEPVKT

SEQ ID NO: 8753 - protein, 16 aa, Mus sp.
KQIVWNGPVGVFEWEA

SEQ ID NO: 8754 - protein, 15 aa, Mus sp.
KNLDYVATSIHEAVT

SEQ ID NO: 8755 - protein, 12 aa, Mus sp.
EEAESFADMMKH

SEQ ID NO: 8756 - protein, 12 aa, Mus sp.
LVLDFVTPTPLG

SEQ ID NO: 8757 - protein, 15 aa, Mus sp.
KVPYVAQEIQEEIDE

SEQ ID NO: 8758 - protein, 12 aa, Mus sp.
DLQYAAPGGLIG

SEQ ID NO: 8759 - protein, 17 aa, Mus sp.
ESEEEYSAPLPTPAPSS

SEQ ID NO: 8760 - protein, 15 aa, Mus sp.
STTEFEEPRVIDLWD

SEQ ID NO: 8761 - protein, 17 aa, Mus sp.
DPDSRGEYSWAVAQGVK

SEQ ID NO: 8762 - protein, 17 aa, Mus sp.
TKKFRFEEPVVLPDLSD

SEQ ID NO: 8763 - protein, 19 aa, Mus sp.
SPPPYAAYATPTPEVYGYG

SEQ ID NO: 8764 - protein, 17 aa, Mus sp.
IPEQSFYTKPLPGIIMG

SEQ ID NO: 8765 - protein, 15 aa, Mus sp.
IARQNFTEPTAIQAQ

SEQ ID NO: 8766 - protein, 20 aa, Mus sp.
NKPTVTVVSPLPNDSINPQP

SEQ ID NO: 8767 - protein, 18 aa, Mus sp.
LLKGQMGLYIFQNTHAID

SEQ ID NO: 8768 - protein, 18 aa, Mus sp.
DLPNSFDGPVTITIVNRD

SEQ ID NO: 8769 - protein, 15 aa, Mus sp.
DIYVWRGAQATLSNT

SEQ ID NO: 8770 - protein, 22 aa, Mus sp.
KDEGKLLEAKGPVTDVAYSHDG

SEQ ID NO: 8771 - protein, 18 aa, Mus sp.
NPTLDHYKEPSAIFQLPY

SEQ ID NO: 8772 - protein, 16 aa, Mus sp.
VPVPGSPFPLEAVAPT

SEQ ID NO: 8773 - protein, 17 aa, Mus sp.
VEPYEVHNPVPLIVGSS

SEQ ID NO: 8774 - protein, 16 aa, Mus sp.
LTTSSYSNPTIGYENR

SEQ ID NO: 8775 - protein, 17 aa, Mus sp.
DLSQHATPLPTPAVLPG

SEQ ID NO: 8776 - protein, 15 aa, Mus sp.
NRYWGTPIPLWVSED

SEQ ID NO: 8777 - protein, 17 aa, Mus sp.
IIEQSWGSPKVTKDGVT

SEQ ID NO: 8778 - protein, 16 aa, Mus sp.
GGDPFAAPQVVPAFAS

SEQ ID NO: 8779 - protein, 16 aa, Mus sp.
WKQKYEETHAELEASQ

SEQ ID NO: 8780 - protein, 14 aa, Mus sp.
DIFIGPKAEEHRGL

SEQ ID NO: 8781 - protein, 17 aa, Mus sp.
LHQALKMLWQNLHQFGQ

SEQ ID NO: 8782 - protein, 13 aa, Mus sp.
NPSYNYEIVNRAS

SEQ ID NO: 8783 - protein, 14 aa, Mus sp.
KVELVPPTPAEIPT

SEQ ID NO: 8784 - protein, 17 aa, Mus sp.
NRPAFMPSEGRMVSDIN

SEQ ID NO: 8785 - protein, 16 aa, Mus sp.
LSLLYKVPYVAQEIQE

SEQ ID NO: 8786 - protein, 13 aa, Mus sp.
VFDVTAPNTFKTL

SEQ ID NO: 8787 - protein, 13 aa, Mus sp.
TPYYVAPEVLGPE

SEQ ID NO: 8788 - protein, 17 aa, Mus sp.
SQELVRAPTAALSPEPQ

SEQ ID NO: 8789 - protein, 14 aa, Mus sp.
LDKDSFSDPYAHVS

SEQ ID NO: 8790 - protein, 17 aa, Mus sp.
EEAGAYDGPRTADGIVS

SEQ ID NO: 8791 - protein, 17 aa, Mus sp.
TSNDVHMYLPTKLFQPS

SEQ ID NO: 8792 - protein, 14 aa, Mus sp.
NVTELNEPLSNEER

SEQ ID NO: 8793 - protein, 19 aa, Mus sp.
DDGTVIHFNNPKVQASLSA

SEQ ID NO: 8794 - protein, 21 aa, Mus sp.
YPNPTLDHYKEPSAIFQLPYE

SEQ ID NO: 8795 - protein, 19 aa, Mus sp.
DPAVIKSLTIQPDPIVVPG

SEQ ID NO: 8796 - protein, 22 aa, Mus sp.
KPAAAKPAATRPLAAAIRPVAT

SEQ ID NO: 8797 - protein, 16 aa, Mus sp.
LTLPDFHVPEITIPEF

SEQ ID NO: 8798 - protein, 19 aa, Mus sp.
DGTVPFWAHAGNAIPSADQ

SEQ ID NO: 8799 - protein, 18 aa, Mus sp.
HNDLQYAAPGGLIGVGTK

SEQ ID NO: 8800 - protein, 15 aa, Mus sp.
DRRYNPPIIHQGFQD

SEQ ID NO: 8801 - protein, 17 aa, Mus sp.
VSTLIWAAPRLQSEVAE

SEQ ID NO: 8802 - protein, 16 aa, Mus sp.
TDKFWGPSGAESVIGG

SEQ ID NO: 8803 - protein, 16 aa, Mus sp.
RPEEVEAEAVNRSITI

SEQ ID NO: 8804 - protein, 18 aa, Mus sp.
VLRYNITHPVVNDADASL

SEQ ID NO: 8805 - protein, 13 aa, Mus sp.
VPSRDYAYSIING

SEQ ID NO: 8806 - protein, 18 aa, Mus sp.
LQSTDYGNFLANEASPLT

SEQ ID NO: 8807 - protein, 15 aa, Mus sp.
FPLATYAPVISAEKA

SEQ ID NO: 8808 - protein, 14 aa, Mus sp.
ALPYDTPVPGYMNN

SEQ ID NO: 8809 - protein, 16 aa, Mus sp.
SSVAFIKPGVNKAEVT

SEQ ID NO: 8810 - protein, 17 aa, Mus sp.
APDTRFVAPGALGNAPW

SEQ ID NO: 8811 - protein, 14 aa, Mus sp.
KQREEYQPATPGLG

SEQ ID NO: 8812 - protein, 19 aa, Mus sp.
LPPHVYSTPQPSLPPVQPS

SEQ ID NO: 8813 - protein, 18 aa, Mus sp.
AGPQWADPQISESNFSPK

SEQ ID NO: 8814 - protein, 15 aa, Mus sp.
INDIIRAPTIEQMKD

SEQ ID NO: 8815 - protein, 20 aa, Mus sp.
DEGKLLEAKGPVTDVAYSHD

SEQ ID NO: 8816 - protein, 18 aa, Mus sp.
GYAVYETPTAHNGAKNPR

SEQ ID NO: 8817 - protein, 16 aa, Mus sp.
EEIEVAPPKAHEVRIK

SEQ ID NO: 8818 - protein, 18 aa, Mus sp.
EPTTLFKTASALRSSAPL

SEQ ID NO: 8819 - protein, 15 aa, Mus sp.
NLLLQSPGVLTAARE

SEQ ID NO: 8820 - protein, 13 aa, Mus sp.
VQIYHNPTANSFR

SEQ ID NO: 8821 - protein, 16 aa, Mus sp.
VPSGLFIPSMAIGAIA

SEQ ID NO: 8822 - protein, 14 aa, Mus sp.
NSVFVAPAVTPVKG

SEQ ID NO: 8823 - protein, 16 aa, Mus sp.
MKVEYHFLSPYVSPRE

SEQ ID NO: 8824 - protein, 17 aa, Mus sp.
MPEMHFKAPKVSLPDVD

SEQ ID NO: 8825 - protein, 17 aa, Mus sp.
GVPTVPLLPPQVNQSLA

SEQ ID NO: 8826 - protein, 18 aa, Mus sp.
TGTTVYRQFWIFDVQNPD

SEQ ID NO: 8827 - protein, 15 aa, Mus sp.
MYKVHNPVPLIVGSS

SEQ ID NO: 8828 - protein, 15 aa, Mus sp.
SKNVFLSPMSISSAL

SEQ ID NO: 8829 - protein, 16 aa, Mus sp.
KRSNEFDYPSVGQLAH

SEQ ID NO: 8830 - protein, 17 aa, Mus sp.
APINAFIGGLAAQEVMK

SEQ ID NO: 8831 - protein, 17 aa, Mus sp.
NVMRIINEPTAAAIAYG

SEQ ID NO: 8832 - protein, 19 aa, Mus sp.
DPAKGRIYQGTEADSIFSG

SEQ ID NO: 8833 - protein, 17 aa, Mus sp.
THDLDFRAPHVLVLGSG

SEQ ID NO: 8834 - protein, 17 aa, Mus sp.
TPRDYYFALAHTVRDHL

SEQ ID NO: 8835 - protein, 15 aa, Mus sp.
GTPDYIAPEIIAYQP

SEQ ID NO: 8836 - protein, 20 aa, Mus sp.
MEKEDRRYNPPIIHQGFQDT

SEQ ID NO: 8837 - protein, 17 aa, Mus sp.
VEYHFLSPYVSPRESPF

SEQ ID NO: 8838 - protein, 16 aa, Mus sp.
RMAPYQGPDAAPGALD

SEQ ID NO: 8839 - protein, 9 aa, Mus sp.
NVEIDPEIQ

SEQ ID NO: 8840 - protein, 15 aa, Mus sp.
YPDSWSTPHSYFSLK

SEQ ID NO: 8841 - protein, 16 aa, Mus sp.
AGPQWADPQISESNFS

SEQ ID NO: 8842 - protein, 15 aa, Mus sp.
GYPTAYPAAAPAYNP

SEQ ID NO: 8843 - protein, 14 aa, Mus sp.
VADKEFHAPLIIDE

SEQ ID NO: 8844 - protein, 15 aa, Mus sp.
LPSTSYLPSTPSVVP

SEQ ID NO: 8845 - protein, 17 aa, Mus sp.
VGTIRYMAPEVLEGAVN

SEQ ID NO: 8846 - protein, 18 aa, Mus sp.
NPLNSVFVAPAVTPVKGV

SEQ ID NO: 8847 - protein, 19 aa, Mus sp.
SEPTTLFKTASALRSSAPL

SEQ ID NO: 8848 - protein, 26 aa, Mus sp.
GEGGEATEQPGLNGAAAAAAAEAPDE

SEQ ID NO: 8849 - protein, 15 aa, Mus sp.
RLEQPNVVISLSRTE

SEQ ID NO: 8850 - protein, 15 aa, Mus sp.
TVIHFNNPKVQASLA

SEQ ID NO: 8851 - protein, 15 aa, Mus sp.
GVNEYGLPMAVAQVL

SEQ ID NO: 8852 - protein, 13 aa, Mus sp.
EVLAPQVVLSLGG

SEQ ID NO: 8853 - protein, 20 aa, Mus sp.
GAEIEYAMAYSKAAFERESD

SEQ ID NO: 8854 - protein, 17 aa, Mus sp.
IASFKDPKISTSLPVLD

SEQ ID NO: 8855 - protein, 20 aa, Mus sp.
FEDYVELPPSVSQAAKSPPG

SEQ ID NO: 8856 - protein, 16 aa, Mus sp.
SFPKFKGSLALRTLDL

SEQ ID NO: 8857 - protein, 16 aa, Mus sp.
RPVQFPYVTPAPHEPV

SEQ ID NO: 8858 - protein, 16 aa, Mus sp.
GVDFIGSTVGLAKVSA

SEQ ID NO: 8859 - protein, 31 aa, Listeria monocytogenes; identical to SEQ ID NO: 420

SEQ ID NO: 8860 - protein, 13 aa, Mus sp.
KGPAFVNPLIPEN

SEQ ID NO: 8861 - protein, 16 aa, Mus sp.
RERYNFPNPNPFVEDD

SEQ ID NO: 8862 - protein, 26 aa, Mus sp.
KVIPELNGKLTGMAFRVPTPNVSVVD

SEQ ID NO: 8863 - protein, 16 aa, Mus sp.
NDLQYAAPGGLIGVGT

SEQ ID NO: 8864 - protein, 14 aa, Mus sp.
TSIEYVTQRNCNLT

SEQ ID NO: 8865 - protein, 16 aa, Mus sp.
DAGNAFKKADPQEAIN

SEQ ID NO: 8866 - protein, 16 aa, Mus sp.
GYKPFQNPVPNQSPSS

SEQ ID NO: 8867 - protein, 18 aa, Mus sp.
VNKGFYKEATQLWGKAEM

SEQ ID NO: 8868 - protein, 17 aa, Mus sp.
EPPPAYEPPAPAPAPLP

SEQ ID NO: 8869 - protein, 16 aa, Mus sp.
GPPPYHESLAGASQPP

SEQ ID NO: 8870 - protein, 16 aa, Mus sp.
DQENKYQASHPNLRRL

SEQ ID NO: 8871 - protein, 15 aa, Mus sp.
ADDYTTANARKLIDE

SEQ ID NO: 8872 - protein, 15 aa, Mus sp.
GKPYVLPSVRKAEAQ

SEQ ID NO: 8873 - protein, 17 aa, Mus sp.
DVRAVAHSPTALISGGT

SEQ ID NO: 8874 - protein, 15 aa, Mus sp.
LDYWTYPGSLTTPPL

SEQ ID NO: 8875 - protein, 14 aa, Mus sp.
IEGYVPSQADVAVF

SEQ ID NO: 8876 - protein, 16 aa, Mus sp.
LQNLYMQWNKISVIGQ

SEQ ID NO: 8877 - protein, 11 aa, Mus sp.
AELLNSKLPRW

SEQ ID NO: 8878 - protein, 14 aa, Mus sp.
ADDTYTESYISTIG

SEQ ID NO: 8879 - protein, 19 aa, Mus sp.
DSRTNTAYVGSAILSEETA

SEQ ID NO: 8880 - protein, 13 aa, Mus sp.
WTYNPAAVSKVAP

SEQ ID NO: 8881 - protein, 12 aa, Mus sp.
INYQPPTVVPGG

SEQ ID NO: 8882 - protein, 14 aa, Mus sp.
LRDNYRFAHTNIES

SEQ ID NO: 8883 - protein, 18 aa, Mus sp.
GDLSQHATPLPTPAVLPG

SEQ ID NO: 8884 - protein, 14 aa, Mus sp.
WSDAAAPFAGLSTD

SEQ ID NO: 8885 - protein, 14 aa, Mus sp.
ADKEFHAPLIIDEN

SEQ ID NO: 8886 - protein, 17 aa, Mus sp.
ELDQLFSGPLPGRLPVN

SEQ ID NO: 8887 - protein, 19 aa, Mus sp.
KAHAFSVEALIGAEKQQQL

SEQ ID NO: 8888 - protein, 13 aa, Mus sp.
DARSYTAAVANRA

SEQ ID NO: 8889 - protein, 18 aa, Mus sp.
KPVPAAPVPSPVAPAPVP

SEQ ID NO: 8890 - protein, 14 aa, Mus sp.
IVYWMTSQPSDAVR

SEQ ID NO: 8891 - protein, 15 aa, Mus sp.
NVLRIINEPTAAAIA

SEQ ID NO: 8892 - protein, 17 aa, Mus sp.
IDDVIYHEAAVRQAGAE

SEQ ID NO: 8893 - protein, 15 aa, Mus sp.
VYTRYHCSLPVPEPS

SEQ ID NO: 8894 - protein, 16 aa, Mus sp.
SPHPYQLPQALAPHVD

SEQ ID NO: 8895 - protein, 18 aa, Mus sp.
YPTPAYTIPFYTPIPNGL

SEQ ID NO: 8896 - protein, 17 aa, Mus sp.
GDVVHGFYNPAVSRIVE

SEQ ID NO: 8897 - protein, 14 aa, Mus sp.
SEEEYSAPLPTPAP

SEQ ID NO: 8898 - protein, 18 aa, Mus sp.
EWTKWVAGSTLPAWIPPS

SEQ ID NO: 8899 - protein, 14 aa, Mus sp.
SIASFKDPKISTSL

SEQ ID NO: 8900 - protein, 21 aa, Mus sp.
RPHDTSLVSWVGSEPMPEAGL

SEQ ID NO: 8901 - protein, 13 aa, Mus sp.
DLLYSFPVVIKNK

SEQ ID NO: 8902 - protein, 14 aa, Mus sp.
KDGYQMAQPVFAPK

SEQ ID NO: 8903 - protein, 17 aa, Mus sp.
ITGVDFIGSTVGLAKVS

SEQ ID NO: 8904 - protein, 15 aa, Mus sp.
SQGNLIPARPAPAPP

SEQ ID NO: 8905 - protein, 15 aa, Mus sp.
GIDPYDQPNAIYIER

SEQ ID NO: 8906 - protein, 21 aa, Mus sp.
EEKPVPAAPVPSPVAPAPVPS

SEQ ID NO: 8907 - protein, 17 aa, Mus sp.
KSFVQNYPVVSIEDPFD

SEQ ID NO: 8908 - protein, 17 aa, Mus sp.
LPETFRRPQIDPAVEGF

SEQ ID NO: 8909 - protein, 15 aa, Mus sp.
TVTYEWAPPVQNQAL

SEQ ID NO: 8910 - protein, 16 aa, Mus sp.
IPEQSFYTKPLPGIIM

SEQ ID NO: 8911 - protein, 13 aa, Mus sp.
KFRFEEPVVLPDL

SEQ ID NO: 8912 - protein, 16 aa, Mus sp.
KERASFITPVPGGVGP

SEQ ID NO: 8913 - protein, 16 aa, Mus sp.
KFDEWVAPTPEVADMQ

SEQ ID NO: 8914 - protein, 15 aa, Mus sp.
IDQYQGADAVGLEEK

SEQ ID NO: 8915 - protein, 20 aa, Mus sp.
KLYFHGVFRQRIEMLLSAQT

SEQ ID NO: 8916 - protein, 18 aa, Mus sp.
GNPLNSVFVAPAVTPVKG

SEQ ID NO: 8917 - protein, 15 aa, Mus sp.
DRKIVYEGPELNHAF

SEQ ID NO: 8918 - protein, 17 aa, Mus sp.
LERESKVVVPPLPGKAF

SEQ ID NO: 8919 - protein, 15 aa, Mus sp.
EPYMYLSPLQQAVSD

SEQ ID NO: 8920 - protein, 22 aa, Mus sp.
GPNDERFGVRFPAMSDAYDRDM

SEQ ID NO: 8921 - protein, 19 aa, Mus sp.
KPVPAAPVPSPVAPAPVPS

SEQ ID NO: 8922 - protein, 19 aa, Mus sp.
FPKPPSYNVATTLPSYDEA

SEQ ID NO: 8923 - protein, 15 aa, Mus sp.
LPANAFASPLQNPDN

SEQ ID NO: 8924 - protein, 17 aa, Mus sp.
TPRVLSQAPSPLYSVEF

SEQ ID NO: 8925 - protein, 16 aa, Mus sp.
DSGGFYISPRSTFSSL

SEQ ID NO: 8926 - protein, 14 aa, Mus sp.
EDKVYWTDVINEAI

SEQ ID NO: 8927 - protein, 14 aa, Mus sp.
SNEFDYPSVGQLAH

SEQ ID NO: 8928 - protein, 16 aa, Mus sp.
VTNLRKMGAPEAGMAE

SEQ ID NO: 8929 - protein, 15 aa, Mus sp.
FPDNYNSPTPYKIQY

SEQ ID NO: 8930 - protein, 16 aa, Mus sp.
APPLPIKTPIPTPSTL

SEQ ID NO: 8931 - protein, 23 aa, Mus sp.
LPEEVGEYRQPSGGSVPVSPGPP

SEQ ID NO: 8932 - protein, 18 aa, Mus sp.
DGDSVVFAGPAGNSVETR

SEQ ID NO: 8933 - protein, 16 aa, Mus sp.
ITPSYYTTSDAVISTE

SEQ ID NO: 8934 - protein, 17 aa, Mus sp.
SNLSYREPDPEDAVGGS

SEQ ID NO: 8935 - protein, 15 aa, Mus sp.
SPVFSPANPESSIED

SEQ ID NO: 8936 - protein, 17 aa, Mus sp.
YSAFSYVDPVITSISPR

SEQ ID NO: 8937 - protein, 15 aa, Mus sp.
LSLLYKVPYVAQEIQ

SEQ ID NO: 8938 - protein, 18 aa, Mus sp.
KPGSDTIKPDVNKSKEYF

SEQ ID NO: 8939 - protein, 18 aa, Mus sp.
GEEAGAYDGPRTADGIVS

SEQ ID NO: 8940 - protein, 17 aa, Listeria monocytogenes
YPGSDETPPVVNPGETN

SEQ ID NO: 8941 - protein, 16 aa, Mus sp.
QASVATNPIITPVAQE

SEQ ID NO: 8942 - protein, 12 aa, Mus sp.
YYRGAQAAIVVY

SEQ ID NO: 8943 - protein, 18 aa, Mus sp.
KKELEEQLGPVAEETRAR

SEQ ID NO: 8944 - protein, 15 aa, Mus sp.
LPNYSSPNALVLNTK

SEQ ID NO: 8945 - protein, 20 aa, Mus sp.
HSMRYFETAVSRPGLEEPRY

SEQ ID NO: 8946 - protein, 16 aa, Mus sp.
IPITYPTTAPEIAVPE

SEQ ID NO: 8947 - protein, 10 aa, Mus sp.
LSYIGPSVNK

SEQ ID NO: 8948 - protein, 20 aa, Mus sp.
NNLGLFINHYPNGVVTVNCA

SEQ ID NO: 8949 - protein, 13 aa, Mus sp.
APYQGPDAAPGAL

SEQ ID NO: 8950 - protein, 15 aa, Mus sp.
SKATYSTNSPVWEEA

SEQ ID NO: 8951 - protein, 15 aa, Mus sp.
IPKVVKSPSSLPAKP

SEQ ID NO: 8952 - protein, 16 aa, Mus sp.
GEQKLFISPGLLPEAP

SEQ ID NO: 8953 - protein, 18 aa, Mus sp.
TDKFWGPSGAESVIGGVH

SEQ ID NO: 8954 - protein, 15 aa, Mus sp.
LVQTYVGAISNGSLP

SEQ ID NO: 8955 - protein, 15 aa, Mus sp.
VFDVTAPNTFKTLDS

SEQ ID NO: 8956 - protein, 18 aa, Mus sp.
AQRAGYKAAIVHNVDSDD

SEQ ID NO: 8957 - protein, 16 aa, Mus sp.
GALLLNAPVVSITQGR

SEQ ID NO: 8958 - protein, 14 aa, Mus sp.
EELVITPLPSGDVA

SEQ ID NO: 8959 - protein, 9 aa, Mus sp.
IPFYTPIPN

SEQ ID NO: 8960 - protein, 18 aa, Mus sp.
AANEKAVHADFFNDFEDL

SEQ ID NO: 8961 - protein, 15 aa, Mus sp.
APFDWEGAQASQALL

SEQ ID NO: 8962 - protein, 16 aa, Mus sp.
YDMNAANVGWNGSTFA

SEQ ID NO: 8963 - protein, 24 aa, Mus sp.
TSPDWAGDMTQGHRSQEELSGPES

SEQ ID NO: 8964 - protein, 13 aa, Mus sp.
SKNVFLSPMSISS

SEQ ID NO: 8965 - protein, 17 aa, Mus sp.
SPPPYAAYATPTPEVYG

SEQ ID NO: 8966 - protein, 16 aa, Mus sp.
AGMAVFTPVINGVGGN

SEQ ID NO: 8967 - protein, 13 aa, Mus sp.
LSIQWESSRPLLA

SEQ ID NO: 8968 - protein, 14 aa, Mus sp.
FRVPTPNVSVVDLT

SEQ ID NO: 8969 - protein, 16 aa, Mus sp.
GSPAFQPPEIANGLDT

SEQ ID NO: 8970 - protein, 16 aa, Mus sp.
SLLYNVPAVAEEIQDE

SEQ ID NO: 8971 - protein, 16 aa, Mus sp.
GDNLVHAAIVAESAAI

SEQ ID NO: 8972 - protein, 21 aa, Mus sp.
GSKVDFVAWATGEPNFANDDE

SEQ ID NO: 8973 - protein, 11 aa, Mus sp.
SVFVAPRKGIY

SEQ ID NO: 8974 - protein, 18 aa, Mus sp.
TPRVLSQAPSPLYSVEFS

SEQ ID NO: 8975 - protein, 15 aa, Mus sp.
LTLMMPYYKLHPESP

SEQ ID NO: 8976 - protein, 16 aa, Mus sp.
PMFIVNTNVPRASVPE

SEQ ID NO: 8977 - protein, 12 aa, Mus sp.
STQLIRNGDWTF

SEQ ID NO: 8978 - protein, 18 aa, Mus sp.
APAPAAAPAAAPAAAPEP

SEQ ID NO: 8979 - protein, 15 aa, Mus sp.
DDPIWRGPLPSNGVM

SEQ ID NO: 8980 - protein, 14 aa, Mus sp.
GVAYEAPSLATGYG

SEQ ID NO: 8981 - protein, 16 aa, Mus sp.
YVPWNFHEPQPGQYEF

SEQ ID NO: 8982 - protein, 14 aa, Mus sp.
SRVQIYHNPTANSF

SEQ ID NO: 8983 - protein, 18 aa, Mus sp.
DPTAGHSNAPIAAPAEVE

SEQ ID NO: 8984 - protein, 16 aa, Mus sp.
ATLEIKGPQADLIDAV

SEQ ID NO: 8985 - protein, 15 aa, Mus sp.
VDVFYSSGIPATARP

SEQ ID NO: 8986 - protein, 14 aa, Listeria monocytogenes
IAVTAFAAPTIASA

SEQ ID NO: 8987 - protein, 16 aa, Mus sp.
KPTVTVVSPLPNDSIN

SEQ ID NO: 8988 - protein, 14 aa, Mus sp.
LPYTASSGLMAPRE

SEQ ID NO: 8989 - protein, 14 aa, Mus sp.
VGDIFSNPEAVLAK

SEQ ID NO: 8990 - protein, 14 aa, Mus sp.
DKEFHAPLIIDENG

SEQ ID NO: 8991 - protein, 17 aa, Mus sp.
GTSWTYNPAAVSKVAPA

SEQ ID NO: 8992 - protein, 11 aa, Mus sp.
FHNPHVNPLPT

SEQ ID NO: 8993 - protein, 17 aa, Mus sp.
NDLQYAAPGGLIGVGTK

SEQ ID NO: 8994 - protein, 19 aa, Mus sp.
RPPGPPPAPQPPSPAPSPP

SEQ ID NO: 8995 - protein, 17 aa, Mus sp.
IPEAQWQSSLARTSSAE

SEQ ID NO: 8996 - protein, 15 aa, Mus sp.
YDVYRYLPPATQVVL

SEQ ID NO: 8997 - protein, 19 aa, Mus sp.
VNGKKFTAPHILIATGGVP

SEQ ID NO: 8998 - protein, 16 aa, Mus sp.
RDNMFSGSKINYTENR

SEQ ID NO: 8999 - protein, 17 aa, Mus sp.
FADDTYTESYISTIGVD

SEQ ID NO: 9000 - protein, 18 aa, Mus sp.
LRKYHLMQFSEVTKAVSE

SEQ ID NO: 9001 - protein, 17 aa, Mus sp.
SVPVTKTNLPNPSVDVK

SEQ ID NO: 9002 - protein, 14 aa, Mus sp.
ASPVFRAPGLTAVA

SEQ ID NO: 9003 - protein, 8 aa, Mus sp.
ATLVFHNL

SEQ ID NO: 9004 - protein, 23 aa, Mus sp.
GPDGKGMNPPSYYTQPVPVPNAN

SEQ ID NO: 9005 - protein, 20 aa, Mus sp.
DDGTVIHFNNPKVQASLSAN

SEQ ID NO: 9006 - protein, 17 aa, Mus sp.
ESKEAFQEALAAAGDKL

SEQ ID NO: 9007 - protein, 9 aa, Mus sp.
KIFEFKETL

SEQ ID NO: 9008 - protein, 8 aa, Mus sp.
FNLVYENL

SEQ ID NO: 9009 - protein, 17 aa, Mus sp.
IDPYDQPNAIYIERHEP

SEQ ID NO: 9010 - protein, 15 aa, Mus sp.
APGGYVAPKAVWLPA

SEQ ID NO: 9011 - protein, 17 aa, Mus sp.
KPTVTVVSPLPNDSINP

SEQ ID NO: 9012 - protein, 17 aa, Mus sp.
GPNFEYAEAPSRLSPDD

SEQ ID NO: 9013 - protein, 11 aa, Mus sp.
LPYKSPGINVD

SEQ ID NO: 9014 - protein, 14 aa, Mus sp.
FDQGYEAPGVREAA

SEQ ID NO: 9015 - protein, 15 aa, Mus sp.
DNMFSGSKINYTENR

SEQ ID NO: 9016 - protein, 15 aa, Mus sp.
AKVELVPPTPAEIPT

SEQ ID NO: 9017 - protein, 15 aa, Mus sp.
GIFQYQQALANMQLQ

SEQ ID NO: 9018 - protein, 17 aa, Mus sp.
REQFSYVLPTVHSLEPS

SEQ ID NO: 9019 - protein, 18 aa, Mus sp.
SILDRYYTPTISRERAVE

SEQ ID NO: 9020 - protein, 15 aa, Mus sp.
DSPDVVYSPETIEAR

SEQ ID NO: 9021 - protein, 15 aa, Mus sp.
LVFDVTAPNTFKTLD

SEQ ID NO: 9022 - protein, 16 aa, Mus sp.
GLEEPVLKHWEPEIPA

SEQ ID NO: 9023 - protein, 15 aa, Mus sp.
KFRFEEPVVLPDLSD

SEQ ID NO: 9024 - protein, 16 aa, Mus sp.
ENLYPYLGPSTLRDRP

SEQ ID NO: 9025 - protein, 19 aa, Mus sp.
EPTSSSPYNPPDLEEAAKT

SEQ ID NO: 9026 - protein, 12 aa, Mus sp.
NWSLPNRAVEPQ

SEQ ID NO: 9027 - protein, 18 aa, Mus sp.
IGRTWNDPSVQQDIKFLP

SEQ ID NO: 9028 - protein, 16 aa, Mus sp.
EAIETIVAAMSNLVPP

SEQ ID NO: 9029 - protein, 16 aa, Mus sp.
LRYNITHPVVNDADAS

SEQ ID NO: 9030 - protein, 15 aa, Mus sp.
WSDAAAPFAGLSTDQ

SEQ ID NO: 9031 - protein, 19 aa, Mus sp.
YKKELEEQLGPVAEETRAR

SEQ ID NO: 9032 - protein, 16 aa, Mus sp.
LITGVDFIGSTVGLAK

SEQ ID NO: 9033 - protein, 16 aa, Mus sp.
SPDVVYSPETIEARYE

SEQ ID NO: 9034 - protein, 18 aa, Mus sp.
LDIYVWRGAQATLSNTTK

SEQ ID NO: 9035 - protein, 20 aa, Mus sp.
AQPTGPPPYHESLAGASQPP

SEQ ID NO: 9036 - protein, 16 aa, Mus sp.
VYTRYHCSLPVPEPSA

SEQ ID NO: 9037 - protein, 17 aa, Mus sp.
NPPSYYTQPVPVPNANA

SEQ ID NO: 9038 - protein, 16 aa, Mus sp.
TVIHFNNPKVQASLSA

SEQ ID NO: 9039 - protein, 16 aa, Mus sp.
DPDGFSWPATLPSVYK

SEQ ID NO: 9040 - protein, 19 aa, Mus sp.
ATITVYSFPESVELRPLPA

SEQ ID NO: 9041 - protein, 17 aa, Mus sp.
VYIFYGASIASLSASHS

SEQ ID NO: 9042 - protein, 16 aa, Mus sp.
MGRERYNFPNPNPFVE

SEQ ID NO: 9043 - protein, 16 aa, Mus sp.
QDPTFHTPLDLYAYAR

SEQ ID NO: 9044 - protein, 16 aa, Mus sp.
PPSYYTQPVPVPNANA

SEQ ID NO: 9045 - protein, 15 aa, Mus sp.
DVDFDFAGPAIHGSA

SEQ ID NO: 9046 - protein, 18 aa, Mus sp.
DSPDVVYSPETIEARYEY

SEQ ID NO: 9047 - protein, 27 aa, Mus sp.
VPPAGGGDPEAPAPAPAAERPPAPGPG

SEQ ID NO: 9048 - protein, 16 aa, Mus sp.
KSFVQNYPVVSIEDPF

SEQ ID NO: 9049 - protein, 16 aa, Mus sp.
GPGDGYGYPRAQHVLS

SEQ ID NO: 9050 - protein, 18 aa, Mus sp.
VDKDQSIAPKTTRVTYPA

SEQ ID NO: 9051 - protein, 14 aa, Mus sp.
KKFRFEEPVVLPDL

SEQ ID NO: 9052 - protein, 17 aa, Mus sp.
GQNAWFLPAQADIVATK

SEQ ID NO: 9053 - protein, 27 aa, Mus sp.
LSPDDADFVDVLHTFTRGSPGRSIGIQ

SEQ ID NO: 9054 - protein, 16 aa, Mus sp.
GIYEYYEPRLSVLPSP

SEQ ID NO: 9055 - protein, 17 aa, Mus sp.
LPDDINVYATTAANPKE

SEQ ID NO: 9056 - protein, 21 aa, Mus sp.
GKLTGMAFRVPTPNVSVVDLT

SEQ ID NO: 9057 - protein, 14 aa, Mus sp.
LDYFKGAIPIRKLV

SEQ ID NO: 9058 - protein, 17 aa, Mus sp.
FAAEEFKVPAATSAIIT

SEQ ID NO: 9059 - protein, 20 aa, Mus sp.
TPSPESPDQWSSSSPHSNIS

SEQ ID NO: 9060 - protein, 17 aa, Mus sp.
ATIQWWNMPSPNVDPYD

SEQ ID NO: 9061 - protein, 27 aa, Mus sp.
GGLDSLIGDSNFGAPSASVAAAPAPAR

SEQ ID NO: 9062 - protein, 17 aa, Mus sp.
GPPPYHESLAGASQPPY

SEQ ID NO: 9063 - protein, 16 aa, Mus sp.
TPERLNSPVTIPAVMF

SEQ ID NO: 9064 - protein, 17 aa, Mus sp.
APAAAEAPAAAEAPAPA

SEQ ID NO: 9065 - protein, 21 aa, Mus sp.
WGIDPYDQPNAIYIERHEPFG

SEQ ID NO: 9066 - protein, 13 aa, Mus sp.
PPSYYTQPVPVPN

SEQ ID NO: 9067 - protein, 15 aa, Mus sp.
SKEAFQEALAAAGDK

SEQ ID NO: 9068 - protein, 14 aa, Mus sp.
EVYHEPHIADAWPQ

SEQ ID NO: 9069 - protein, 16 aa, Mus sp.
SIVYWMTSQPSDAVRF

SEQ ID NO: 9070 - protein, 17 aa, Mus sp.
EWKDYKAGFGNLEREFW

SEQ ID NO: 9071 - protein, 15 aa, Mus sp.
HWGEWSPAHPLEAED

SEQ ID NO: 9072 - protein, 12 aa, Mus sp.
VQIYHNPTANSF

SEQ ID NO: 9073 - protein, 16 aa, Mus sp.
KERYSYVCPDLVKEFN

SEQ ID NO: 9074 - protein, 13 aa, Listeria monocytogenes
WNEKYAQAYPNVS

SEQ ID NO: 9075 - protein, 11 aa, Mus sp.
DIEADHVGTYG

SEQ ID NO: 9076 - protein, 22 aa, Listeria monocytogenes
VMASDYTRGLSIRAIELVFENL

SEQ ID NO: 9077 - protein, 13 aa, Mus sp.
SIASFKDPKISTS

SEQ ID NO: 9078 - protein, 14 aa, Mus sp.
NELDYYDSPSVNAR

SEQ ID NO: 9079 - protein, 14 aa, Mus sp.
KFRFEEPVVLPDLS

SEQ ID NO: 9080 - protein, 15 aa, Mus sp.
EGPRYLSSTAVVVAE

SEQ ID NO: 9081 - protein, 15 aa, Mus sp.
AYWEVKYPFPLSNRD

SEQ ID NO: 9082 - protein, 17 aa, Mus sp.
DERFGVRFPAMSDAYDR

SEQ ID NO: 9083 - protein, 15 aa, Mus sp.
APPLPIKTPIPTPST

SEQ ID NO: 9084 - protein, 17 aa, Mus sp.
TTVSLSAPDALKIITEN

SEQ ID NO: 9085 - protein, 17 aa, Mus sp.
DINAFVGAVSLTAADSN

SEQ ID NO: 9086 - protein, 14 aa, Mus sp.
EVWERPLSNLAWAV

SEQ ID NO: 9087 - protein, 8 aa, Mus sp.
TIIIFHSL

SEQ ID NO: 9088 - protein, 16 aa, Mus sp.
IFGIHHNPSVWPDPEV

SEQ ID NO: 9089 - protein, 15 aa, Mus sp.
FFWNVAPGAESAVAS

SEQ ID NO: 9090 - protein, 16 aa, Mus sp.
EAINDYKGAVIVVSHD

SEQ ID NO: 9091 - protein, 18 aa, Mus sp.
RTDWEAPTGQPSAPGPRP

SEQ ID NO: 9092 - protein, 22 aa, Mus sp.
LPNKPTVTVVSPLPNDSINPQP

SEQ ID NO: 9093 - protein, 15 aa, Mus sp.
RDKWLAPDGLIFPDR

SEQ ID NO: 9094 - protein, 17 aa, Mus sp.
DPEDHTVSFVQPNGAIF

SEQ ID NO: 9095 - protein, 16 aa, Mus sp.
SKTVYEGPFASRSLSD

SEQ ID NO: 9096 - protein, 14 aa, Mus sp.
IPVYRFVLPANAFA

SEQ ID NO: 9097 - protein, 15 aa, Mus sp.
IVDPYNNPVPRGLEA

SEQ ID NO: 9098 - protein, 20 aa, BOVIN
GPPVASVVVGPSVVAVPLPL

SEQ ID NO: 9099 - protein, 16 aa, Mus sp.
DGDSVVFAGPAGNSVE

SEQ ID NO: 9100 - protein, 21 aa, Mus sp.
DQGNRITPSYVAFTPEGERLI

SEQ ID NO: 9101 - protein, 14 aa, Mus sp.
DGYQMAQPVFAPKN

SEQ ID NO: 9102 - protein, 18 aa, Mus sp.
KVGGERFEAPEALFQPHL

SEQ ID NO: 9103 - protein, 16 aa, Mus sp.
SGPKPFSAPKPQTSPS

SEQ ID NO: 9104 - protein, 20 aa, Mus sp.
NWPHLEEARVVAVSDGETKF

SEQ ID NO: 9105 - protein, 12 aa, Mus sp.
DDIEADHVGTYG

SEQ ID NO: 9106 - protein, 19 aa, Mus sp.
IDLKGIPVYRFVLPANAFA

SEQ ID NO: 9107 - protein, 17 aa, Mus sp.
APLDELVGAYPNYNEEE

SEQ ID NO: 9108 - protein, 15 aa, Mus sp.
EEEYYAEPGVTEAEP

SEQ ID NO: 9109 - protein, 22 aa, Mus sp.
DYNRDGDSYRSPWSNKYDPPLE

SEQ ID NO: 9110 - protein, 15 aa, Mus sp.
VNGKKFTAPHILIAT

SEQ ID NO: 9111 - protein, 17 aa, Mus sp.
MPEMNIKAPKISMPDID

SEQ ID NO: 9112 - protein, 18 aa, Mus sp.
ELGRPDAEYWNSQPEILE

SEQ ID NO: 9113 - protein, 17 aa, Mus sp.
APAPAPAAAPAPAPAAQ

SEQ ID NO: 9114 - protein, 17 aa, Mus sp.
KDPFWWNGAEPIWVTNQ

SEQ ID NO: 9115 - protein, 18 aa, Mus sp.
EQIYYAGPVNNPGLDVPQ

SEQ ID NO: 9116 - protein, 15 aa, Mus sp.
HIPEFQLPHLSHTIE

SEQ ID NO: 9117 - protein, 16 aa, Mus sp.
DTNLNDLGPRALEIYR

SEQ ID NO: 9118 - protein, 27 aa, Mus sp.
IPISKVKDVYVITDQIPVFVTMSQKND

SEQ ID NO: 9119 - protein, 17 aa, Mus sp.
MPDMHFKAPKISMPDVD

SEQ ID NO: 9120 - protein, 18 aa, Mus sp.
DTPTDVTHHPIPSEEDIN

SEQ ID NO: 9121 - protein, 12 aa, Mus sp.
LVYTSPVIPELK

SEQ ID NO: 9122 - protein, 17 aa, Mus sp.
TWSDAAAPFAGLSTDQT

SEQ ID NO: 9123 - protein, 18 aa, Mus sp.
AQPPEYTFPSGSGAHFPQ

SEQ ID NO: 9124 - protein, 15 aa, Mus sp.
SGVEWKGPQVSSSLN

SEQ ID NO: 9125 - protein, 17 aa, Mus sp.
APAAATSAPAPAPAPAP

SEQ ID NO: 9126 - protein, 15 aa, Mus sp.
AISYVAALPAAALWH

SEQ ID NO: 9127 - protein, 17 aa, Mus sp.
DPSAFAAAAPAAAATTA

SEQ ID NO: 9128 - protein, 15 aa, Mus sp.
TGMAFRVPTPNVSVV

SEQ ID NO: 9129 - protein, 15 aa, Mus sp.
GTPEFLAPEVLTDTS

SEQ ID NO: 9130 - protein, 16 aa, Mus sp.
TIEFRGPNGLLVYQGK

SEQ ID NO: 9131 - protein, 15 aa, Mus sp.
SCKYSHLITSHQFQP

SEQ ID NO: 9132 - protein, 17 aa, Mus sp.
GKKFTAPHILIATGGVP

SEQ ID NO: 9133 - protein, 18 aa, Mus sp.
IGGDTHFDSAEPWTVQNE

SEQ ID NO: 9134 - protein, 17 aa, Mus sp.
WGIDPYDQPNAIYIERH

SEQ ID NO: 9135 - protein, 18 aa, Mus sp.
YPRDISNYGFPRSVQAID

SEQ ID NO: 9136 - protein, 15 aa, Mus sp.
VGINYQPPTVVPGGD

SEQ ID NO: 9137 - protein, 16 aa, Mus sp.
KAVDVFFPPEAQNDFP

SEQ ID NO: 9138 - protein, 17 aa, Mus sp.
DYVELPPSVSQAATSPP

SEQ ID NO: 9139 - protein, 21 aa, Mus sp.
DPAGPNFEYAEAPSRLSPDDA

SEQ ID NO: 9140 - protein, 16 aa, Mus sp.
SVTYYGPSGQKTIYSE

SEQ ID NO: 9141 - protein, 22 aa, Mus sp.
GGDPEAPAPAPAAERPPAPGPG

SEQ ID NO: 9142 - protein, 12 aa, Mus sp.
FRVPTPNVSVVD

SEQ ID NO: 9143 - protein, 18 aa, Mus sp.
TKKFRFEEPVVLPDLSDQ

SEQ ID NO: 9144 - protein, 20 aa, Mus sp.
RPPGPPPAPQPPSPAPSPPP

SEQ ID NO: 9145 - protein, 18 aa, Mus sp.
VPDDLLYSFPVVIKNKTW

SEQ ID NO: 9146 - protein, 13 aa, Mus sp.
ALPYDTPVPGYMN

SEQ ID NO: 9147 - protein, 15 aa, Mus sp.
VDPYEEADAQIAQER

SEQ ID NO: 9148 - protein, 12 aa, Mus sp.
TPEYLAPEIILS

SEQ ID NO: 9149 - protein, 18 aa, Mus sp.
NKPEDYQGGRTGEAIVDA

SEQ ID NO: 9150 - protein, 14 aa, Mus sp.
AVDVFFPPEAQNDF

SEQ ID NO: 9151 - protein, 30 aa, Mus sp.; identical to SEQ ID NO: 2540

SEQ ID NO: 9152 - protein, 16 aa, Mus sp.
APASAEAPAPNQAPAP

SEQ ID NO: 9153 - protein, 12 aa, Mus sp.
LPYDTPVPGYMN

SEQ ID NO: 9154 - protein, 18 aa, Mus sp.
DPGVPSEWTSPASAGSSD

SEQ ID NO: 9155 - protein, 18 aa, Mus sp.
YTWSDAAAPFAGLSTDQT

SEQ ID NO: 9156 - protein, 16 aa, Mus sp.
DDIRSDWTNPEINKAV

SEQ ID NO: 9157 - protein, 12 aa, Mus sp.
DSERHFVYQFMG

SEQ ID NO: 9158 - protein, 12 aa, Mus sp.
IQEPYTFPAILK

SEQ ID NO: 9159 - protein, 13 aa, Mus sp.
RSYSSPDITQALQ

SEQ ID NO: 9160 - protein, 16 aa, Mus sp.
SFVNIVERDRTLGYQE

SEQ ID NO: 9161 - protein, 16 aa, Mus sp.
GDSNFGAPSASVAAAP

SEQ ID NO: 9162 - protein, 14 aa, Mus sp.
TQLIRNGDWTFQVL

SEQ ID NO: 9163 - protein, 13 aa, Mus sp.
EQIYYAGPVNNPG

SEQ ID NO: 9164 - protein, 17 aa, Mus sp.
EEKYTVIYPYTARDQDE

SEQ ID NO: 9165 - protein, 16 aa, Mus sp.
KKAGYITPVPGGVGPM

SEQ ID NO: 9166 - protein, 14 aa, Mus sp.
SPNYAAPEVISGRL

SEQ ID NO: 9167 - protein, 17 aa, Mus sp.
GNPLNSVFVAPAVTPVK

SEQ ID NO: 9168 - protein, 16 aa, Mus sp.
LDKEIYYHGEPISVNV

SEQ ID NO: 9169 - protein, 18 aa, Mus sp.
RLYKKAYNDHKAKISIPV

SEQ ID NO: 9170 - protein, 17 aa, Mus sp.
KPVPAAPVPSPVAPAPV

SEQ ID NO: 9171 - protein, 13 aa, Mus sp.
VEGYEGSAASIST

SEQ ID NO: 9172 - protein, 15 aa, Mus sp.
AFPFESGKPFKIQVL

SEQ ID NO: 9173 - protein, 19 aa, Mus sp.
WGIDPYDQPNAIYIERHEP

SEQ ID NO: 9174 - protein, 17 aa, Mus sp.
NNIPYFETSAKEAINVE

SEQ ID NO: 9175 - protein, 13 aa, Mus sp.
SLKYHFVTPLTSM

SEQ ID NO: 9176 - protein, 16 aa, Mus sp.
IPKTKFGKPDPIVSVI

SEQ ID NO: 9177 - protein, 15 aa, Mus sp.
AAVAWEAGKPLSIEE

SEQ ID NO: 9178 - protein, 19 aa, Mus sp.
EMEKEDRRYNPPIIHQGFQ

SEQ ID NO: 9179 - protein, 21 aa, Mus sp.
GPHSMRYFETAVSRPGLEEPR

SEQ ID NO: 9180 - protein, 17 aa, Mus sp.
ISKQEYDESGPSIVHRK

SEQ ID NO: 9181 - protein, 17 aa, Mus sp.
EAPAAAEAPAAAEAPAA

SEQ ID NO: 9182 - protein, 14 aa, Mus sp.
KQLTYTYPLVYDHK

SEQ ID NO: 9183 - protein, 13 aa, Mus sp.
IASFKDPKISTSL

SEQ ID NO: 9184 - protein, 14 aa, Mus sp.
DTEVYESPYADPEE

SEQ ID NO: 9185 - protein, 17 aa, Mus sp.
MPDMHFKTPKISMPDVD

SEQ ID NO: 9186 - protein, 18 aa, Mus sp.
ITIGNERFRCPEAIFQPS

SEQ ID NO: 9187 - protein, 13 aa, Mus sp.
AGNFYVPAEPKLA

SEQ ID NO: 9188 - protein, 22 aa, Mus sp.
NDQGNRITPSYVAFTPEGERLI

SEQ ID NO: 9189 - protein, 17 aa, Mus sp.
ADKTVKGPDGLTALEAT

SEQ ID NO: 9190 - protein, 16 aa, Mus sp.
FPLATYAPVISAEKAY

SEQ ID NO: 9191 - protein, 13 aa, Mus sp.
FDFAGPAIHGSAV

SEQ ID NO: 9192 - protein, 15 aa, Mus sp.
GGVYASPSIAGSRPG

SEQ ID NO: 9193 - protein, 11 aa, Mus sp.
RYMAPEVLDET

SEQ ID NO: 9194 - protein, 12 aa, Mus sp.
GLPDYSAPNPIK

SEQ ID NO: 9195 - protein, 30 aa, Mus sp.; identical to SEQ ID NO: 3000

SEQ ID NO: 9196 - protein, 16 aa, Mus sp.
APTPAATPAASPAPVS

SEQ ID NO: 9197 - protein, 15 aa, Mus sp.
ALPYDTPVPGYMNNT

SEQ ID NO: 9198 - protein, 17 aa, Mus sp.
SPDVVYSPETIEARYEY

SEQ ID NO: 9199 - protein, 14 aa, Mus sp.
TPEFLAPEVLTDTS

SEQ ID NO: 9200 - protein, 17 aa, Mus sp.
SLEDFYGSPIPSVSLKL

SEQ ID NO: 9201 - protein, 14 aa, Mus sp.
GIFKGPTAENAEYL

SEQ ID NO: 9202 - protein, 18 aa, Mus sp.
GPDGRFVMGPTVAPSQEK

SEQ ID NO: 9203 - protein, 16 aa, Mus sp.
VELPPSVSQAATSPPG

SEQ ID NO: 9204 - protein, 27 aa, Mus sp.
VIPELNGKLTGMAFRVPTPNVSVVDLT

SEQ ID NO: 9205 - protein, 18 aa, Mus sp.
RSFFWNVAPGAESAVASF

SEQ ID NO: 9206 - protein, 15 aa, Mus sp.
GSVLWERPVAQDVAL

SEQ ID NO: 9207 - protein, 15 aa, Mus sp.
SSIASFKDPKISTSL

SEQ ID NO: 9208 - protein, 17 aa, Mus sp.
ENLYPYLGPSTLRDRPQ

SEQ ID NO: 9209 - protein, 17 aa, Mus sp.
APMYYRGAQAAIVVYDI

SEQ ID NO: 9210 - protein, 14 aa, Mus sp.
SFFWNVAPGAESAV

SEQ ID NO: 9211 - protein, 14 aa, Mus sp.
KIGEHTPSALAIME

SEQ ID NO: 9212 - protein, 13 aa, Mus sp.
LEEQLGPVAEETR

SEQ ID NO: 9213 - protein, 18 aa, Mus sp.
FHKAFLEVNEEGSEAAAS

SEQ ID NO: 9214 - protein, 27 aa, Mus sp.
DEPQGWDLVDAVTPSPQPSKEEDGPPA

SEQ ID NO: 9215 - protein, 16 aa, Mus sp.
IEHLYKNPQAHIEGNM

SEQ ID NO: 9216 - protein, 15 aa, Mus sp.
LPYKSPGINVDSSYK

SEQ ID NO: 9217 - protein, 14 aa, Mus sp.
FGPYYTEPVIAGLD

SEQ ID NO: 9218 - protein, 14 aa, Mus sp.
VNWYAPLVAPISKD

SEQ ID NO: 9219 - protein, 13 aa, Mus sp.
ITWTWQGPGALKI

SEQ ID NO: 9220 - protein, 16 aa, Mus sp.
DHPGNYVEPTIVTGLA

SEQ ID NO: 9221 - protein, 24 aa, Mus sp.
EEKYHEALAKGDVTTQVALQPALK

SEQ ID NO: 9222 - protein, 17 aa, Mus sp.
LNLAYIGAVPHSGIEQV

SEQ ID NO: 9223 - protein, 16 aa, Mus sp.
VLRIINEPTAAAIAYG

SEQ ID NO: 9224 - protein, 17 aa, Mus sp.
HWGEWSPAHPLEAEDTR

SEQ ID NO: 9225 - protein, 15 aa, Mus sp.
SEEEYSAPLPTPAPS

SEQ ID NO: 9226 - protein, 16 aa, Mus sp.
QSTDYGNFLANEASPL

SEQ ID NO: 9227 - protein, 16 aa, Mus sp.
TNDRYVASLAARNKVG

SEQ ID NO: 9228 - protein, 14 aa, Mus sp.
ITTDYNSPEAGNIF

SEQ ID NO: 9229 - protein, 15 aa, Mus sp.
GDQPVFEIPLSNVSQ

SEQ ID NO: 9230 - protein, 17 aa, Mus sp.
FPTDYPFKPPKVAFTTR

SEQ ID NO: 9231 - protein, 14 aa, Mus sp.
IEQSWGSPKVTKDG

SEQ ID NO: 9232 - protein, 15 aa, Mus sp.
DSSKNVFLSPMSISS

SEQ ID NO: 9233 - protein, 15 aa, Mus sp.
IASFKDPKISTSLPV

SEQ ID NO: 9234 - protein, 16 aa, Mus sp.
GAPFDWEGAQASQALL

SEQ ID NO: 9235 - protein, 16 aa, Mus sp.
TRSQVTPSVPSEALDD

SEQ ID NO: 9236 - protein, 14 aa, Mus sp.
YEGYALPHAILRLD

SEQ ID NO: 9237 - protein, 13 aa, Mus sp.
ETTIWVSPSPILE

SEQ ID NO: 9238 - protein, 13 aa, Mus sp.
ATNPIITPVAQEN

SEQ ID NO: 9239 - protein, 16 aa, Mus sp.
FINIYSASSVSEVNDG

SEQ ID NO: 9240 - protein, 16 aa, Mus sp.
NSTDGGSFCHVKASPI

SEQ ID NO: 9241 - protein, 21 aa, Mus sp.
APETRSQVTPSVPSEALDDST

SEQ ID NO: 9242 - protein, 15 aa, Mus sp.
TPATNEAPQATVFPK

SEQ ID NO: 9243 - protein, 16 aa, Mus sp.
KGPAFVNPLIPENKEE

SEQ ID NO: 9244 - protein, 15 aa, Mus sp.
GEFDYSGSQAIKALK

SEQ ID NO: 9245 - protein, 16 aa, Mus sp.
LPAAAQAPDALPAGWE

SEQ ID NO: 9246 - protein, 14 aa, Mus sp.
YALVYTSPVIPELK

SEQ ID NO: 9247 - protein, 16 aa, Mus sp.
KEFEFIESQTSSHRIN

SEQ ID NO: 9248 - protein, 17 aa, Mus sp.
GGPGSAVSPYPSFNVSS

SEQ ID NO: 9249 - protein, 17 aa, Mus sp.
AARDNMFSGSKINYTEN

SEQ ID NO: 9250 - protein, 15 aa, Mus sp.
IWRDYVPPTANLDQK

SEQ ID NO: 9251 - protein, 16 aa, Mus sp.
GLPDYSAPNPIKVTHR

SEQ ID NO: 9252 - protein, 19 aa, Mus sp.
GELTYENVQVSPVPGGPPG

SEQ ID NO: 9253 - protein, 8 aa, Mus sp.
SSIASFKD

SEQ ID NO: 9254 - protein, 14 aa, Mus sp.
ATNPIITPVAQENQ

SEQ ID NO: 9255 - protein, 18 aa, Mus sp.
IFSPYFINGQQLHLSEDM

SEQ ID NO: 9256 - protein, 13 aa, Mus sp.
FPYEGPAPLEAIA

SEQ ID NO: 9257 - protein, 8 aa, Mus sp.
ASYEFTTL

SEQ ID NO: 9258 - protein, 18 aa, Mus sp.
DGNHTLFHNPHVNPLPTG

SEQ ID NO: 9259 - protein, 18 aa, Mus sp.
AGDAVAVAPAPAAAVEPA

SEQ ID NO: 9260 - protein, 16 aa, Mus sp.
YKRSNEFDYPSVGQLA

SEQ ID NO: 9261 - protein, 14 aa, Mus sp.
DPAWEAPEGVPIDA

SEQ ID NO: 9262 - protein, 14 aa, Mus sp.
ECGENFSRISHLVQ

SEQ ID NO: 9263 - protein, 17 aa, Mus sp.
ITSSYYRGAHGIIVVYD

SEQ ID NO: 9264 - protein, 15 aa, Mus sp.
EEWGPFKAPHANRFI

SEQ ID NO: 9265 - protein, 17 aa, Mus sp.
DSNFGAPSASVAAAPAP

SEQ ID NO: 9266 - protein, 23 aa, Mus sp.
VPPAGGGDPEAPAPAPAAERPPA

SEQ ID NO: 9267 - protein, 31 aa, Mus sp.; identical to SEQ ID NO: 1455

SEQ ID NO: 9268 - protein, 16 aa, Mus sp.
DPYDQPNAIYIERHEP

SEQ ID NO: 9269 - protein, 14 aa, Mus sp.
VDPYNNPVPRGLEA

SEQ ID NO: 9270 - protein, 18 aa, Mus sp.
FPPEFYEHAKALWEDEGV

SEQ ID NO: 9271 - protein, 18 aa, Mus sp.
LADPSAFAAAAPAAAATT

SEQ ID NO: 9272 - protein, 16 aa, Mus sp.
LDSQYRASAPNSHVPL

SEQ ID NO: 9273 - protein, 16 aa, Mus sp.
EEVEHWFYPQENIIDT

SEQ ID NO: 9274 - protein, 16 aa, Mus sp.
VAVNWYAPLVAPISKD

SEQ ID NO: 9275 - protein, 17 aa, Mus sp.
GEQKLFISPGLLPEAPT

SEQ ID NO: 9276 - protein, 16 aa, Mus sp.
NLDYVATSIHEAVTKI

SEQ ID NO: 9277 - protein, 15 aa, Mus sp.
TPWKAPIVWEGTYDT

SEQ ID NO: 9278 - protein, 16 aa, Mus sp.
YAVDIRSPAISWVNNL

SEQ ID NO: 9279 - protein, 13 aa, Mus sp.
WWRSPEPGPSAPG

SEQ ID NO: 9280 - protein, 22 aa, Mus sp.
IDVDPQEDPQNAPDVNYVVENP

SEQ ID NO: 9281 - protein, 14 aa, Mus sp.
APMYYRGAQAAIVV

SEQ ID NO: 9282 - protein, 22 aa, Mus sp.
DGNHTLFHNPHVNPLPTGYEDE

SEQ ID NO: 9283 - protein, 13 aa, Mus sp.
GDIFIGPKAEEHR

SEQ ID NO: 9284 - protein, 16 aa, Mus sp.
LQSTDYGNFLANEASP

SEQ ID NO: 9285 - protein, 15 aa, Mus sp.
MAPYQGPDAAPGALD

SEQ ID NO: 9286 - protein, 15 aa, Mus sp.
EGEMTLKSALALAVK

SEQ ID NO: 9287 - protein, 14 aa, Mus sp.
LDIDSAPITARNTG

SEQ ID NO: 9288 - protein, 13 aa, Mus sp.
FKVLAPQISFGLD

SEQ ID NO: 9289 - protein, 14 aa, Mus sp.
GYTYTASAIKHVIT

SEQ ID NO: 9290 - protein, 13 aa, Mus sp.
LSYREPDPEDAVG

SEQ ID NO: 9291 - protein, 17 aa, Mus sp.
EPLSTVTAPDSPEAAEQ

SEQ ID NO: 9292 - protein, 16 aa, Mus sp.
VGINYQPPTVVPGGDL

SEQ ID NO: 9293 - protein, 15 aa, Mus sp.
VKELFTTPVLRASVS

SEQ ID NO: 9294 - protein, 15 aa, Mus sp.
AEDVTFIGPDTHAIQ

SEQ ID NO: 9295 - protein, 20 aa, Mus sp.
VDPTPDPNTAYASYPSASVE

SEQ ID NO: 9296 - protein, 17 aa, Mus sp.
DYVELPPSVSQAAKSPP

SEQ ID NO: 9297 - protein, 16 aa, Mus sp.
GQDHVDFSQPEPHTVL

SEQ ID NO: 9298 - protein, 21 aa, Mus sp.
QPTGPPPYHESLAGASQPPYN

SEQ ID NO: 9299 - protein, 11 aa, Mus sp.
SYPVYLMEQQN

SEQ ID NO: 9300 - protein, 18 aa, Mus sp.
DYVELPPSVSQAAKSPPG

SEQ ID NO: 9301 - protein, 16 aa, Mus sp.
TSDIFGSPVTATAPLA

SEQ ID NO: 9302 - protein, 14 aa, Mus sp.
FDNYEGSAPNLYVW

SEQ ID NO: 9303 - protein, 17 aa, Mus sp.
EKEDRRYNPPIIHQGFQ

SEQ ID NO: 9304 - protein, 19 aa, Mus sp.
SSIASFKDPKISTSLPVLD

SEQ ID NO: 9305 - protein, 15 aa, Mus sp.
LEGDIFIGPKAEEHR

SEQ ID NO: 9306 - protein, 14 aa, Mus sp.
KRYMAPEVLDDSIN

SEQ ID NO: 9307 - protein, 14 aa, Mus sp.
LRDWESPYSHDLDT

SEQ ID NO: 9308 - protein, 17 aa, Mus sp.
LIGRTWNDPSVQQDIKF

SEQ ID NO: 9309 - protein, 19 aa, Mus sp.
EDDIEADHVGTYGISVYQS

SEQ ID NO: 9310 - protein, 18 aa, Mus sp.
APAAATSAPAPAPAPAPA

SEQ ID NO: 9311 - protein, 16 aa, Mus sp.
GYGPYSGAYPAGTQVV

SEQ ID NO: 9312 - protein, 15 aa, Mus sp.
TITVQGPKSSRSLPV

SEQ ID NO: 9313 - protein, 19 aa, Mus sp.
TGTTVYRQFWIFDVQNPDD

SEQ ID NO: 9314 - protein, 15 aa, Mus sp.
EWKDYKAGFGNLERE

SEQ ID NO: 9315 - protein, 16 aa, Mus sp.
VMRIINEPTAAAIAYG

SEQ ID NO: 9316 - protein, 15 aa, Mus sp.
GINYQPPTVVPGGDL

SEQ ID NO: 9317 - protein, 15 aa, Mus sp.
LNLDWQYPGSRGSPP

SEQ ID NO: 9318 - protein, 20 aa, Mus sp.
IGDSNFGAPSASVAAAPAPA

SEQ ID NO: 9319 - protein, 16 aa, Mus sp.
FKKPSWLTPVPESHKL

SEQ ID NO: 9320 - protein, 15 aa, Mus sp.
TSDIFGSPVTATAPL

SEQ ID NO: 9321 - protein, 16 aa, Mus sp.
APGGYVAPKAVWLPAV

SEQ ID NO: 9322 - protein, 15 aa, Mus sp.
IYEGYALPHAILRLD

SEQ ID NO: 9323 - protein, 19 aa, Mus sp.
SPGILQASPTPLLAAAAPA

SEQ ID NO: 9324 - protein, 24 aa, Mus sp.
SPDDADFVDVLHTFTRGSPGRSIG

SEQ ID NO: 9325 - protein, 19 aa, Mus sp.
GLDIYVWRGAQATLSNTTK

SEQ ID NO: 9326 - protein, 17 aa, Mus sp.
ADPSAFAAAAPAAAATT

SEQ ID NO: 9327 - protein, 15 aa, Mus sp.
LPPHVYSTPQPSLPP

SEQ ID NO: 9328 - protein, 15 aa, Mus sp.
EDAIQFATGMANALE

SEQ ID NO: 9329 - protein, 16 aa, Mus sp.
AQPATAPQAAAAQEPG

SEQ ID NO: 9330 - protein, 16 aa, Mus sp.
ASVATNPIITPVAQEN

SEQ ID NO: 9331 - protein, 16 aa, Mus sp.
VADKEFHAPLIIDENG

SEQ ID NO: 9332 - protein, 20 aa, Mus sp.
EMEKEDRRYNPPIIHQGFQD

SEQ ID NO: 9333 - protein, 15 aa, Mus sp.
FGTGHSAPSASPAFG

SEQ ID NO: 9334 - protein, 16 aa, Mus sp.
APDTRFVAPGALGNAP

SEQ ID NO: 9335 - protein, 18 aa, Mus sp.
GKLLEAKGPVTDVAYSHD

SEQ ID NO: 9336 - protein, 15 aa, Mus sp.
VGTKRYMAPEVLDDS

SEQ ID NO: 9337 - protein, 17 aa, Mus sp.
GVPVPGSPFPLEAVAPT

SEQ ID NO: 9338 - protein, 14 aa, Mus sp.
YTPYYVAPEVLGPE

SEQ ID NO: 9339 - protein, 19 aa, Mus sp.
DDERVVGFHVLGPNAGEVT

SEQ ID NO: 9340 - protein, 18 aa, Mus sp.
ESLHLRFSAPQIENEPET

SEQ ID NO: 9341 - protein, 13 aa, Mus sp.
DNMFSGSKINYTE

SEQ ID NO: 9342 - protein, 14 aa, Mus sp.
LSYNEPLSLKTEAF

SEQ ID NO: 9343 - protein, 17 aa, Mus sp.
RAKQIVWNGPVGVFEWE

SEQ ID NO: 9344 - protein, 19 aa, Mus sp.
LPQDPTFHTPLDLYAYARA

SEQ ID NO: 9345 - protein, 11 aa, Mus sp.
LPDYSAPNPIK

SEQ ID NO: 9346 - protein, 17 aa, Mus sp.
KPWNQYRLPKTLIPDSY

SEQ ID NO: 9347 - protein, 19 aa, Mus sp.
AGPNFEYAEAPSRLSPDDA

SEQ ID NO: 9348 - protein, 15 aa, Mus sp.
KIGEHTPSALAIMEN

SEQ ID NO: 9349 - protein, 21 aa, Mus sp.
DYNRDGDSYRSPWSNKYDPPL

SEQ ID NO: 9350 - protein, 14 aa, Mus sp.
SVPATFAPSPTPAV

SEQ ID NO: 9351 - protein, 23 aa, Mus sp.
VDPTPDPNTAYASYPSASVENYQ

SEQ ID NO: 9352 - protein, 14 aa, Mus sp.
GVELYRAPFPLYAL

SEQ ID NO: 9353 - protein, 20 aa, Mus sp.
SKIETLTLAKNYIKSLTATI

SEQ ID NO: 9354 - protein, 20 aa, Mus sp.
VDLYTAKGLFRAAVPSGAST

SEQ ID NO: 9355 - protein, 17 aa, Mus sp.
EEWGPFKAPHANRFIFS

SEQ ID NO: 9356 - protein, 16 aa, Mus sp.
TSSYSNPTIGYENRVL

SEQ ID NO: 9357 - protein, 16 aa, Mus sp.
EQEVLAPQVVLSLGGS

SEQ ID NO: 9358 - protein, 18 aa, Mus sp.
ADGREVSSVEAPSVSPAR

SEQ ID NO: 9359 - protein, 15 aa, Mus sp.
LSEGFSSPSSLMSPS

SEQ ID NO: 9360 - protein, 21 aa, Mus sp.
LVVSNITRLIDLPGTELAQLM

SEQ ID NO: 9361 - protein, 14 aa, Mus sp.
DNMFSGSKINYTEN

SEQ ID NO: 9362 - protein, 15 aa, Mus sp.
EVEHWFYPQENIIDT

SEQ ID NO: 9363 - protein, 17 aa, Mus sp.
LAPMYYRGAQAAIVVYD

SEQ ID NO: 9364 - protein, 20 aa, Mus sp.
DKSYIEGYVPSQADVAVFEA

SEQ ID NO: 9365 - protein, 13 aa, Mus sp.
GGHKLGLALELEA

SEQ ID NO: 9366 - protein, 14 aa, Mus sp.
DASFVAAIPSTQVV

SEQ ID NO: 9367 - protein, 13 aa, Mus sp.
DTIEFRGPNGLLV

SEQ ID NO: 9368 - protein, 17 aa, Mus sp.
IDWTYRPPSSSRTESIF

SEQ ID NO: 9369 - protein, 14 aa, Mus sp.
IDIFARPTAGFITG

SEQ ID NO: 9370 - protein, 14 aa, Mus sp.
IQWESSRPLLASIE

SEQ ID NO: 9371 - protein, 15 aa, Mus sp.
VQLVEYEASAAGLIR

SEQ ID NO: 9372 - protein, 15 aa, Mus sp.
IRGTSYQSPHGIPID

SEQ ID NO: 9373 - protein, 18 aa, Mus sp.
APPLPIKTPIPTPSTLPA

SEQ ID NO: 9374 - protein, 16 aa, Mus sp.
DVVHGFYNPAVSRIVE

SEQ ID NO: 9375 - protein, 17 aa, Mus sp.
EGPEASTPMPSPSPSPS

SEQ ID NO: 9376 - protein, 15 aa, Mus sp.
DVYVFLGPEPKSVVQ

SEQ ID NO: 9377 - protein, 15 aa, Mus sp.
ITPSYVAFTPEGERL

SEQ ID NO: 9378 - protein, 20 aa, Mus sp.
MIPVWPFPYLSVGTMLKNLN

SEQ ID NO: 9379 - protein, 14 aa, Mus sp.
RTVITPDPNLSIDQ

SEQ ID NO: 9380 - protein, 14 aa, Mus sp.
DLLYSFPVVIKNKT

SEQ ID NO: 9381 - protein, 15 aa, Mus sp.
GTPEYLAPEIILSKG

SEQ ID NO: 9382 - protein, 15 aa, Mus sp.
LEHSNDPSAIMAPFY

SEQ ID NO: 9383 - protein, 17 aa, Mus sp.
SPLVHVLMGNVYILFPP

SEQ ID NO: 9384 - protein, 9 aa, Mus sp.
AVYTFETLL

SEQ ID NO: 9385 - protein, 21 aa, Listeria monocytogenes
ESVYLSAQKENPRLFAKIETF

SEQ ID NO: 9386 - protein, 21 aa, Mus sp.
KNVSINTVTYEWAPPVQNQAL

SEQ ID NO: 9387 - protein, 15 aa, Mus sp.
EEVNIKTAEAQLAYE

SEQ ID NO: 9388 - protein, 24 aa, Mus sp.
FPGPNIGGDTHFDSAEPWTVQNED

SEQ ID NO: 9389 - protein, 16 aa, Mus sp.
GKITTDYNSPEAGNIF

SEQ ID NO: 9390 - protein, 19 aa, Mus sp.
IGGDTHFDSAEPWTVQNED

SEQ ID NO: 9391 - protein, 14 aa, Mus sp.
LSLKYHFVTPLTSM

SEQ ID NO: 9392 - protein, 14 aa, Mus sp.
IFYGASIASLSASH

SEQ ID NO: 9393 - protein, 15 aa, Mus sp.
TPSYYTTSDAVISTE

SEQ ID NO: 9394 - protein, 14 aa, Mus sp.
FPIKWTAPEAALFG

SEQ ID NO: 9395 - protein, 14 aa, Mus sp.
YEWAPPVQNQALAR

SEQ ID NO: 9396 - protein, 11 aa, Mus sp.
AWTGPMGNWAM

SEQ ID NO: 9397 - protein, 17 aa, Mus sp.
WSDAAAPFAGLSTDQTL

SEQ ID NO: 9398 - protein, 17 aa, Mus sp.
GIDPYDQPNAIYIERHE

SEQ ID NO: 9399 - protein, 14 aa, Mus sp.
DYVPPTANLDQKDK

SEQ ID NO: 9400 - protein, 21 aa, Listeria monocytogenes
SSYPGSDETPPVVNPGETNPP

SEQ ID NO: 9401 - protein, 18 aa, Mus sp.
NRITPSYVAFTPEGERLI

SEQ ID NO: 9402 - protein, 16 aa, Mus sp.
VGAGHFRSPHTTEVVG

SEQ ID NO: 9403 - protein, 17 aa, Mus sp.
ITPSYYTTSDAVISTET

SEQ ID NO: 9404 - protein, 15 aa, Mus sp.
DNYLTSPLPEEVDET

SEQ ID NO: 9405 - protein, 14 aa, Mus sp.
FYQHPNLMRALGMH

SEQ ID NO: 9406 - protein, 18 aa, Mus sp.
APDAWDYSQGFVNEEMIR

SEQ ID NO: 9407 - protein, 12 aa, Mus sp.
RQTTQYPEANAL

SEQ ID NO: 9408 - protein, 18 aa, Mus sp.
DSSRLPSEGPQPAHVVVG

SEQ ID NO: 9409 - protein, 14 aa, Mus sp.
LFPQYTAPSILPSD

SEQ ID NO: 9410 - protein, 17 aa, Mus sp.
AAPHIYQNSFVQVVLNS

SEQ ID NO: 9411 - protein, 20 aa, Mus sp.
DGDLERFLSSAAAVSKEHPV

SEQ ID NO: 9412 - protein, 19 aa, Mus sp.
GGDTHFDSAEPWTVQNEDL

SEQ ID NO: 9413 - protein, 19 aa, Mus sp.
DPSQKQNLLAPQNAVSSEE

SEQ ID NO: 9414 - protein, 17 aa, Mus sp.
EDRRYNPPIIHQGFQDT

SEQ ID NO: 9415 - protein, 15 aa, Mus sp.
GRPDAEYWNSQPEIL

SEQ ID NO: 9416 - protein, 18 aa, Mus sp.
IGDTIEFRGPNGLLVYQG

SEQ ID NO: 9417 - protein, 14 aa, Mus sp.
IGDSNFGAPSASVA

SEQ ID NO: 9418 - protein, 26 aa, Mus sp.
DYKDESGFPKPPSYNVATTLPSYDEA

SEQ ID NO: 9419 - protein, 15 aa, Mus sp.
SVPATFAPSPTPAVV

SEQ ID NO: 9420 - protein, 14 aa, Mus sp.
AGPQWADPQISESN

SEQ ID NO: 9421 - protein, 15 aa, Listeria monocytogenes
YMEKHSVSRLVGAPP

SEQ ID NO: 9422 - protein, 14 aa, Mus sp.
IRYMAPEVLEGAVN

SEQ ID NO: 9423 - protein, 17 aa, Mus sp.
IEQFVYSSPHDNKSWEM

SEQ ID NO: 9424 - protein, 15 aa, Mus sp.
KPPSYNVATTLPSYD

SEQ ID NO: 9425 - protein, 22 aa, Mus sp.
RRKGEQIYYAGPVNNPGLDVPQ

SEQ ID NO: 9426 - protein, 17 aa, Mus sp.
EGEMTLKSALALAVKVL

SEQ ID NO: 9427 - protein, 18 aa, Mus sp.
DLGSDIFAAPAPQSTATA

SEQ ID NO: 9428 - protein, 15 aa, Mus sp.
IDWREPEGKEVWDYV

SEQ ID NO: 9429 - protein, 16 aa, Mus sp.
PLNSVFVAPAVTPVKG

SEQ ID NO: 9430 - protein, 24 aa, Mus sp.
LPDGRIIKVGGERFEAPEALFQPH

SEQ ID NO: 9431 - protein, 15 aa, Mus sp.
LPNVQVEGPTPNRPR

SEQ ID NO: 9432 - protein, 17 aa, Mus sp.
RPVFDWKDPLILEEQLT

SEQ ID NO: 9433 - protein, 19 aa, Mus sp.
DDPTAGHSNAPIAAPAEVE

SEQ ID NO: 9434 - protein, 15 aa, Mus sp.
ADFHYAASKALRVPA

SEQ ID NO: 9435 - protein, 13 aa, Mus sp.
LAWNAPAVLQKPY

SEQ ID NO: 9436 - protein, 17 aa, Mus sp.
SSSIASFKDPKISTSLP

SEQ ID NO: 9437 - protein, 14 aa, Mus sp.
DSKIVVPPLPGKAL

SEQ ID NO: 9438 - protein, 18 aa, Mus sp.
GPRPEEYEFLTPVEEAPK

SEQ ID NO: 9439 - protein, 15 aa, Mus sp.
ADHFEIRFPLALDVK

SEQ ID NO: 9440 - protein, 17 aa, Mus sp.
VPSVIYTHPEVAWVGKS

SEQ ID NO: 9441 - protein, 15 aa, Mus sp.
LDNYDAPDIANIAIS

SEQ ID NO: 9442 - protein, 16 aa, Mus sp.
ANPDFTQPISEVVDEV

SEQ ID NO: 9443 - protein, 18 aa, Mus sp.
NSNSYGIPEPAHAYAQPQ

SEQ ID NO: 9444 - protein, 20 aa, Mus sp.
AGCEEAKLEIMEFVNFLKNP

SEQ ID NO: 9445 - protein, 16 aa, Mus sp.
TGVDFIGSTVGLAKVS

SEQ ID NO: 9446 - protein, 16 aa, Mus sp.
LHLRFSAPQIENEPET

SEQ ID NO: 9447 - protein, 13 aa, Mus sp.
VKDGYQMAQPVFA

SEQ ID NO: 9448 - protein, 15 aa, Mus sp.
AFDTRAPMAAQGMVE

SEQ ID NO: 9449 - protein, 19 aa, Mus sp.
SSSIASFKDPKISTSLPVL

SEQ ID NO: 9450 - protein, 16 aa, Mus sp.
GFQAYDFPAITTAQYS

SEQ ID NO: 9451 - protein, 13 aa, Mus sp.
GIPVYRFVLPANA

SEQ ID NO: 9452 - protein, 18 aa, Mus sp.
KGPAFVNPLIPENKEEEE

SEQ ID NO: 9453 - protein, 10 aa, Mus sp.
FGIHNGVETL

SEQ ID NO: 9454 - protein, 20 aa, Mus sp.
IGDTIEFRGPNGLLVYQGKG

SEQ ID NO: 9455 - protein, 13 aa, Mus sp.
YLPYKSPGINVDS

SEQ ID NO: 9456 - protein, 14 aa, Mus sp.
KKNWFGPSPYVEVT

SEQ ID NO: 9457 - protein, 16 aa, Mus sp.
EDYVELPPSVSQAAKS

SEQ ID NO: 9458 - protein, 17 aa, Mus sp.
DGKKFKLEAPDADELPR

SEQ ID NO: 9459 - protein, 19 aa, Mus sp.
LPPYDDATAVPSTAKEPPP

SEQ ID NO: 9460 - protein, 18 aa, Mus sp.
VADKEFHAPLIIDENGVH

SEQ ID NO: 9461 - protein, 20 aa, Mus sp.
SSRAVYLSSKLRGVSLQTTG

SEQ ID NO: 9462 - protein, 16 aa, Mus sp.
YTLWKEFFFSVPAGPP

SEQ ID NO: 9463 - protein, 24 aa, Mus sp.
TPARAPETRSQVTPSVPSEALDDS

SEQ ID NO: 9464 - protein, 19 aa, Mus sp.
EAARDNMFSGSKINYTENR

SEQ ID NO: 9465 - protein, 14 aa, Mus sp.
KNLDYVATSIHEAV

SEQ ID NO: 9466 - protein, 14 aa, Mus sp.
GVDFIGSTVGLAKV

SEQ ID NO: 9467 - protein, 18 aa, Mus sp.
GGDTHFDSAEPWTVQNED

SEQ ID NO: 9468 - protein, 14 aa, Mus sp.
VATNPIITPVAQEN

SEQ ID NO: 9469 - protein, 18 aa, Mus sp.
SIPEAQWQSSLARTSSAE

SEQ ID NO: 9470 - protein, 15 aa, Mus sp.
GNHYFYSPYPTKTQT

SEQ ID NO: 9471 - protein, 15 aa, Mus sp.
YEDKVYWTDVINEAI

SEQ ID NO: 9472 - protein, 15 aa, Mus sp.
DKQREEYQPATPGLG

SEQ ID NO: 9473 - protein, 12 aa, Mus sp.
NELDYYDSPSVN

SEQ ID NO: 9474 - protein, 15 aa, Mus sp.
RPVQFPYVTPAPHEP

SEQ ID NO: 9475 - protein, 17 aa, Mus sp.
FPLKEDNWSLPNRAVEP

SEQ ID NO: 9476 - protein, 18 aa, Mus sp.
DTDRQVWSGSKAAGAPPK

SEQ ID NO: 9477 - protein, 14 aa, Mus sp.
LPPYDDATAVPSTA

SEQ ID NO: 9478 - protein, 23 aa, Mus sp.
GPPGFEDYVELPPSVSQAAKSPP

SEQ ID NO: 9479 - protein, 14 aa, Mus sp.
VTPWKAPIVWEGTY

SEQ ID NO: 9480 - protein, 18 aa, Mus sp.
WDLVDAVTPSPQPSKEED

SEQ ID NO: 9481 - protein, 19 aa, Mus sp.
VGTPDYISPEVLKSQGGDG

SEQ ID NO: 9482 - protein, 14 aa, Mus sp.
EPVWRSEQAIGAIA

SEQ ID NO: 9483 - protein, 17 aa, Mus sp.
LNVLRIINEPTAAAIAY

SEQ ID NO: 9484 - protein, 14 aa, Mus sp.
SPYINPIIPFTGPI

SEQ ID NO: 9485 - protein, 24 aa, Mus sp.
TPSPESPDQWSSSSPHSNISDWSE

SEQ ID NO: 9486 - protein, 16 aa, Mus sp.
EKPVPAAPVPSPVAPA

SEQ ID NO: 9487 - protein, 15 aa, Mus sp.
EPPPAYEPPAPAPAP

SEQ ID NO: 9488 - protein, 18 aa, Mus sp.
CASLLRARLLLQLAQSQQ

SEQ ID NO: 9489 - protein, 14 aa, Mus sp.
SQPLLLGIACNETS

SEQ ID NO: 9490 - protein, 16 aa, Mus sp.
KTLAYLFSGAAAAAEA

SEQ ID NO: 9491 - protein, 24 aa, Mus sp.
EETELDQLFSGPLPGRLPVNHRPF

SEQ ID NO: 9492 - protein, 15 aa, Mus sp.
GTPYWMSPEVISGEG

SEQ ID NO: 9493 - protein, 17 aa, Mus sp.
LLEAKGPVTDVAYSHDG

SEQ ID NO: 9494 - protein, 20 aa, Mus sp.
DPEDHTVSFVQPNGAIFEPS

SEQ ID NO: 9495 - protein, 14 aa, Mus sp.
AGNFYVPAEPKLAF

SEQ ID NO: 9496 - protein, 14 aa, Mus sp.
RLDNYDAPDIANIA

SEQ ID NO: 9497 - protein, 13 aa, Mus sp.
GYVPSQADVAVFE

SEQ ID NO: 9498 - protein, 18 aa, Mus sp.
EKTGQEYKPGNPSAAAVQ

SEQ ID NO: 9499 - protein, 13 aa, Mus sp.
GNSEFDPPGPNVA

SEQ ID NO: 9500 - protein, 14 aa, Mus sp.
GNSEFDPPGPNVAT

SEQ ID NO: 9501 - protein, 15 aa, Mus sp.
ASLEDFYGSPIPSVS

SEQ ID NO: 9502 - protein, 17 aa, Mus sp.
YPNTPYISPVASYSGQP

SEQ ID NO: 9503 - protein, 13 aa, Mus sp.
VHLRVFQPLPHEN

SEQ ID NO: 9504 - protein, 22 aa, Mus sp.
GPHSMRYFETAVSRPGLEEPRY

SEQ ID NO: 9505 - protein, 24 aa, Mus sp.
GDEDLETKKFRFEEPVVLPDLSDQ

SEQ ID NO: 9506 - protein, 16 aa, Mus sp.
FNPGDASGPEAAGSPP

SEQ ID NO: 9507 - protein, 13 aa, Mus sp.
GTSYQSPHGIPID

SEQ ID NO: 9508 - protein, 18 aa, Mus sp.
LPQDPTFHTPLDLYAYAR

SEQ ID NO: 9509 - protein, 16 aa, Mus sp.
KWKALYTDPKSSETAA

SEQ ID NO: 9510 - protein, 16 aa, Mus sp.
IARQNFTEPTAIQAQG

SEQ ID NO: 9511 - protein, 17 aa, Mus sp.
GKKVIYSQPSTRSEGEF

SEQ ID NO: 9512 - protein, 14 aa, Mus sp.
AEEYEFLTPMEEAP

SEQ ID NO: 9513 - protein, 16 aa, Mus sp.
YPNSFSAPEQQRSALE

SEQ ID NO: 9514 - protein, 16 aa, Mus sp.
VEPYEVHNPVPLIVGS

SEQ ID NO: 9515 - protein, 19 aa, Mus sp.
LPTELSNTYTFPNPAHPPG

SEQ ID NO: 9516 - protein, 16 aa, Mus sp.
QIYYAGPVNNPGLDVP

SEQ ID NO: 9517 - protein, 13 aa, Mus sp.
DAYHFFSPEPLNS

SEQ ID NO: 9518 - protein, 22 aa, Mus sp.
GPDGKGMNPPSYYTQPVPVPNA

SEQ ID NO: 9519 - protein, 15 aa, Mus sp.
SLKYHFVTPLTSMVV

SEQ ID NO: 9520 - protein, 17 aa, Mus sp.
TDINAFVGAVSLTAADS

SEQ ID NO: 9521 - protein, 12 aa, Mus sp.
GAWTGPMGNWAM

SEQ ID NO: 9522 - protein, 17 aa, Mus sp.
NPTDAYLDAMMNEAPGP

SEQ ID NO: 9523 - protein, 16 aa, Mus sp.
IWRDYVPPTANLDQKD

SEQ ID NO: 9524 - protein, 13 aa, Mus sp.
DEATRYLAPTILT

SEQ ID NO: 9525 - protein, 17 aa, Mus sp.
ISLPHFLHASPDVSEPI

SEQ ID NO: 9526 - protein, 18 aa, Mus sp.
FPKPPSYNVATTLPSYDE

SEQ ID NO: 9527 - protein, 24 aa, Mus sp.
DSGDGVTHTVPIYEGYALPHAILR

SEQ ID NO: 9528 - protein, 14 aa, Mus sp.
EALVGPEANVGPYG

SEQ ID NO: 9529 - protein, 16 aa, Mus sp.
LNLAYIGAVPHSGIEQ

SEQ ID NO: 9530 - protein, 15 aa, Mus sp.
GVDFIGSTVGLAKVS

SEQ ID NO: 9531 - protein, 20 aa, Mus sp.
LEALGHMFMYFLRGSLPWQG

SEQ ID NO: 9532 - protein, 17 aa, Mus sp.
DLPNSFDGPVTITIVNR

SEQ ID NO: 9533 - protein, 15 aa, BOVIN
AVPDAAGPTPSAAGP

SEQ ID NO: 9534 - protein, 21 aa, Mus sp.
EPSKLKRSYSSPDITQALQEE

SEQ ID NO: 9535 - protein, 16 aa, Mus sp.
FNLDAEAPAVLSGPPG

SEQ ID NO: 9536 - protein, 15 aa, Mus sp.
APPHFHFGQTNRTPE

SEQ ID NO: 9537 - protein, 16 aa, Mus sp.
IQPFHRAAAIQAISLD

SEQ ID NO: 9538 - protein, 17 aa, Mus sp.
DGDSVVFAGPAGNSVET

SEQ ID NO: 9539 - protein, 16 aa, Mus sp.
TVDVVLTPLVAEALDR

SEQ ID NO: 9540 - protein, 16 aa, Mus sp.
KLGMLTIGVDLQGVLM

SEQ ID NO: 9541 - protein, 16 aa, Mus sp.
KPSTFAYPAPLEVPKE

SEQ ID NO: 9542 - protein, 17 aa, Mus sp.
LDIYVWRGAQATLSNTT

SEQ ID NO: 9543 - protein, 13 aa, Mus sp.
ADKEFHAPLIIDE

SEQ ID NO: 9544 - protein, 18 aa, Mus sp.
DVKKPAAAPAPAPAPAPA

SEQ ID NO: 9545 - protein, 20 aa, Mus sp.
EGKLLEAKGPVTDVAYSHDG

SEQ ID NO: 9546 - protein, 16 aa, Mus sp.
GTIRYMAPEVLEGAVN

SEQ ID NO: 9547 - protein, 16 aa, Mus sp.
LYPDTAGPEAALEAED

SEQ ID NO: 9548 - protein, 20 aa, Mus sp.
ESTEQLPNVQVEGPTPNRPR

SEQ ID NO: 9549 - protein, 14 aa, Mus sp.
GAFTYYGVSALTAP

SEQ ID NO: 9550 - protein, 18 aa, Mus sp.
GIDPYDQPNAIYIERHEP

SEQ ID NO: 9551 - protein, 18 aa, Listeria monocytogenes
VDDTTVKFTLPTVAPAFE

SEQ ID NO: 9552 - protein, 16 aa, Mus sp.
KKELEEQLGPVAEETR

SEQ ID NO: 9553 - protein, 16 aa, Mus sp.
IPEAQWQSSLARTSSA

SEQ ID NO: 9554 - protein, 14 aa, Mus sp.
RERYNFPNPNPFVE

SEQ ID NO: 9555 - protein, 15 aa, Mus sp.
KWKYEKPDGSPVFIA

SEQ ID NO: 9556 - protein, 15 aa, Mus sp.
TARYMAPEVLESRMN

SEQ ID NO: 9557 - protein, 17 aa, Mus sp.
TQSSCYISQLMFFMKSP

SEQ ID NO: 9558 - protein, 15 aa, Mus sp.
AEEVYRNSMPASSFQ

SEQ ID NO: 9559 - protein, 12 aa, Mus sp.
YEGYALPHAILR

SEQ ID NO: 9560 - protein, 12 aa, Mus sp.
YLPYKSPGINVD

SEQ ID NO: 9561 - protein, 14 aa, Mus sp.
SKATYSTNSPVWEE

SEQ ID NO: 9562 - protein, 16 aa, Mus sp.
VYIPTYTKPNPNQIIS

SEQ ID NO: 9563 - protein, 18 aa, Mus sp.
SPALVSYASSLPAQVGTI

SEQ ID NO: 9564 - protein, 14 aa, Mus sp.
GNVYIHPTAKVAPS

SEQ ID NO: 9565 - protein, 18 aa, Mus sp.
YPYPTDFLGPLPANPVKV

SEQ ID NO: 9566 - protein, 20 aa, Mus sp.
VTEDNVFEAPTLVKVFKQPS

SEQ ID NO: 9567 - protein, 16 aa, Mus sp.
AQLNYWSAKSLWAKLD

SEQ ID NO: 9568 - protein, 20 aa, Mus sp.
EGPEVDVSLPKANIDVSGPK

SEQ ID NO: 9569 - protein, 13 aa, Mus sp.
VLLPFFDPDTNIV

SEQ ID NO: 9570 - protein, 17 aa, Mus sp.
VHKSFVEVNEEGTEAAA

SEQ ID NO: 9571 - protein, 22 aa, Mus sp.
APETRSQVTPSVPSEALDDSTG

SEQ ID NO: 9572 - protein, 16 aa, Mus sp.
ADEPVWRSEQAIGAIA

SEQ ID NO: 9573 - protein, 15 aa, Mus sp.
VNSQYQEPDIIIHFA

SEQ ID NO: 9574 - protein, 21 aa, Mus sp.
TPSPTPENEDLHAATVNPDPS

SEQ ID NO: 9575 - protein, 16 aa, Mus sp.
EAPQATVFPKSPVLLG

SEQ ID NO: 9576 - protein, 15 aa, Mus sp.
GDPFAAPQVVPAFAS

SEQ ID NO: 9577 - protein, 20 aa, Mus sp.
APETRSQVTPSVPSEALDDS

SEQ ID NO: 9578 - protein, 14 aa, Mus sp.
KQIDYTVPTVIAEE

SEQ ID NO: 9579 - protein, 14 aa, Mus sp.
TPDIIINPHAIPSR

SEQ ID NO: 9580 - protein, 16 aa, Mus sp.
GQNAWFLPAQADIVAT

SEQ ID NO: 9581 - protein, 21 aa, Mus sp.
TPSPESPDQWSSSSPHSASDW

SEQ ID NO: 9582 - protein, 17 aa, Mus sp.
DPKLTYHGFTLEDAASP

SEQ ID NO: 9583 - protein, 18 aa, Mus sp.
EDYVELPPSVSQAAKSPP

SEQ ID NO: 9584 - protein, 15 aa, Mus sp.
MDEAYVQPEPLGVVL

SEQ ID NO: 9585 - protein, 15 aa, Mus sp.
KFIYVDVLPEEAVGP

SEQ ID NO: 9586 - protein, 15 aa, Mus sp.
APTSALGPKASPAPS

SEQ ID NO: 9587 - protein, 15 aa, Mus sp.
VPPPFAAAAINEAID

SEQ ID NO: 9588 - protein, 14 aa, Mus sp.
ITWTWQGPGALKIL

SEQ ID NO: 9589 - protein, 21 aa, Mus sp.
VDLYTAKGLFRAAVPSGASTG

SEQ ID NO: 9590 - protein, 16 aa, Mus sp.
SVPATFAPSPTPAVVS

SEQ ID NO: 9591 - protein, 16 aa, Mus sp.
VTYEWAPPVQNQALAR

SEQ ID NO: 9592 - protein, 16 aa, Mus sp.
SPVDFHTPSSPKSPPS

SEQ ID NO: 9593 - protein, 24 aa, Mus sp.
GQDGEQAPPLPIKTPIPTPSTLPA

SEQ ID NO: 9594 - protein, 24 aa, Mus sp.
GPPGFEDYVELPPSVSQAATSPPG

SEQ ID NO: 9595 - protein, 16 aa, Mus sp.
EVSSVEAPSVSPARHQ

SEQ ID NO: 9596 - protein, 20 aa, Mus sp.
SPGFSSEVYTFPVPERHLER

SEQ ID NO: 9597 - protein, 20 aa, Mus sp.
EEKPVPAAPVPSPVAPAPVP

SEQ ID NO: 9598 - protein, 15 aa, Mus sp.
QNAWFLPAQADIVAT

SEQ ID NO: 9599 - protein, 21 aa, Mus sp.
SPLPVPVYAPKIPNQFRPDPP

SEQ ID NO: 9600 - protein, 19 aa, Mus sp.
GVPDDLLYSFPVVIKNKTW

SEQ ID NO: 9601 - protein, 15 aa, Mus sp.
VGTARYMAPEVLESR

SEQ ID NO: 9602 - protein, 16 aa, Mus sp.
GPNFEYAEAPSRLSPD

SEQ ID NO: 9603 - protein, 12 aa, Mus sp.
YNPPIIHQGFQD

SEQ ID NO: 9604 - protein, 23 aa, Mus sp.
KPSEGEEEAASAGGPQVNPMPVT

SEQ ID NO: 9605 - protein, 18 aa, Mus sp.
GPDFEYVSPIPAWARDDW

SEQ ID NO: 9606 - protein, 22 aa, Mus sp.
GVEAARDNMFSGSKINYTENRA

SEQ ID NO: 9607 - protein, 15 aa, Mus sp.
YYNEVHSPSVAVEMG

SEQ ID NO: 9608 - protein, 15 aa, Mus sp.
GYTYTASAIKHVITE

SEQ ID NO: 9609 - protein, 14 aa, Mus sp.
KFDEWVAPTPEVAD

SEQ ID NO: 9610 - protein, 15 aa, Mus sp.
VLIPYQGPSSDYVVV

SEQ ID NO: 9611 - protein, 16 aa, Mus sp.
APISSHTAPRPNPTPA

SEQ ID NO: 9612 - protein, 11 aa, Mus sp.
PKISTSLPVLD

SEQ ID NO: 9613 - protein, 15 aa, Mus sp.
RPEEVEAEAVNRSIT

SEQ ID NO: 9614 - protein, 16 aa, Mus sp.
EAPAAAEAPAAAEAPA

SEQ ID NO: 9615 - protein, 14 aa, Mus sp.
KKAGYITPVPGGVG

SEQ ID NO: 9616 - protein, 17 aa, Mus sp.
EIKVYWDAPSPAPDHIR

SEQ ID NO: 9617 - protein, 16 aa, Mus sp.
IEGYVPSQADVAVFEA

SEQ ID NO: 9618 - protein, 17 aa, Mus sp.
DFLKKWETPSQNTAQLD

SEQ ID NO: 9619 - protein, 21 aa, Mus sp.
NGKLTGMAFRVPTPNVSVVDL

SEQ ID NO: 9620 - protein, 25 aa, Mus sp.
DPTPDPNTAYASYPSASVENYQQPP

SEQ ID NO: 9621 - protein, 13 aa, Mus sp.
APDTRFVAPGALG

SEQ ID NO: 9622 - protein, 17 aa, Mus sp.
SPSSPEYTPASPKYSPT

SEQ ID NO: 9623 - protein, 15 aa, Mus sp.
GERFEAPEALFQPHL

SEQ ID NO: 9624 - protein, 15 aa, Mus sp.
NPDFTQPISEVVDEV

SEQ ID NO: 9625 - protein, 17 aa, Mus sp.
GPGLDFEGPDAKLSGPN

SEQ ID NO: 9626 - protein, 16 aa, Mus sp.
SPPPYAAYATPTPEVY

SEQ ID NO: 9627 - protein, 21 aa, Mus sp.
GPPRLDLLDLAPEPRYAHIPV

SEQ ID NO: 9628 - protein, 18 aa, Mus sp.
KPKGQLPDYTSPVVLPYS

SEQ ID NO: 9629 - protein, 16 aa, Mus sp.
LDNYLTSPLPEEVDET

SEQ ID NO: 9630 - protein, 16 aa, Mus sp.
VPFWAHAGNAIPSADQ

SEQ ID NO: 9631 - protein, 16 aa, Mus sp.
MQLTYLPPSPVLAEST

SEQ ID NO: 9632 - protein, 16 aa, Mus sp.
LEDFYGSPIPSVSLKL

SEQ ID NO: 9633 - protein, 18 aa, Mus sp.
EVERRLTSPVINTSLDTK

SEQ ID NO: 9634 - protein, 17 aa, Mus sp.
EPKESVLPPKTSAAAQL

SEQ ID NO: 9635 - protein, 14 aa, Mus sp.
VQIYHNPTANSFRV

SEQ ID NO: 9636 - protein, 14 aa, Mus sp.
TPYGAYNGPVPGYQ

SEQ ID NO: 9637 - protein, 16 aa, Mus sp.
HTSYYSESVVRESYIG

SEQ ID NO: 9638 - protein, 18 aa, Mus sp.
DTIEFRGPNGLLVYQGKG

SEQ ID NO: 9639 - protein, 16 aa, Mus sp.
VRLVSQEPKALVSEWK

SEQ ID NO: 9640 - protein, 12 aa, Mus sp.
LPYKSPGINVDS

SEQ ID NO: 9641 - protein, 15 aa, Mus sp.
LGVAYEAPSLATGYG

SEQ ID NO: 9642 - protein, 17 aa, Mus sp.
EQLPNVQVEGPTPNRPR

SEQ ID NO: 9643 - protein, 15 aa, Mus sp.
IYYAGPVNNPGLDVP

SEQ ID NO: 9644 - protein, 16 aa, Mus sp.
VVDNVSSPETIVVFNG

SEQ ID NO: 9645 - protein, 17 aa, Mus sp.
NPEKHIYSSITTWETTE

SEQ ID NO: 9646 - protein, 16 aa, Mus sp.
VPTDKYYGAQTVRSTM

SEQ ID NO: 9647 - protein, 20 aa, Mus sp.
SANAIYSLAARPLPMPKLPP

SEQ ID NO: 9648 - protein, 14 aa, Mus sp.
VFDVTAPNTFKTLD

SEQ ID NO: 9649 - protein, 16 aa, Mus sp.
NQLEALVGPEANVGPY

SEQ ID NO: 9650 - protein, 16 aa, Mus sp.
VPNDKWFGSGALLSES

SEQ ID NO: 9651 - protein, 14 aa, Mus sp.
FETFNTPAMYVAIQ

SEQ ID NO: 9652 - protein, 17 aa, Mus sp.
EATRYLAPTILTDVDPN

SEQ ID NO: 9653 - protein, 17 aa, Mus sp.
SSIASFKDPKISTSLPV

SEQ ID NO: 9654 - protein, 14 aa, Mus sp.
GPVAPFVAAIPLLA

SEQ ID NO: 9655 - protein, 15 aa, Mus sp.
ADKTVKGPDGLTALE

SEQ ID NO: 9656 - protein, 14 aa, Mus sp.
TPWKAPIVWEGTYD

SEQ ID NO: 9657 - protein, 29 aa, Mus sp.
AVGKVIPELNGKLTGMAFRVPTPNVSVVD

SEQ ID NO: 9658 - protein, 20 aa, Mus sp.
QLQPQPATLLGKAGAFPPPA

SEQ ID NO: 9659 - protein, 15 aa, Mus sp.
NVTELNEPLSNEERN

SEQ ID NO: 9660 - protein, 18 aa, Mus sp.
LPKEELYMPPLVIKVIDH

SEQ ID NO: 9661 - protein, 17 aa, Mus sp.
EPTTLFKTASALRSSAP

SEQ ID NO: 9662 - protein, 19 aa, Mus sp.
DAFKHAVSDPSILDSLDLN

SEQ ID NO: 9663 - protein, 22 aa, Mus sp.
KPTVTVVSPLPNDSINPQPSPD

SEQ ID NO: 9664 - protein, 17 aa, Mus sp.
VPDVQFKTPQISMSDID

SEQ ID NO: 9665 - protein, 17 aa, Mus sp.
APAAAATTAAPAAAAAP

SEQ ID NO: 9666 - protein, 13 aa, Mus sp.
GSPNYAAPEVISG

SEQ ID NO: 9667 - protein, 16 aa, Mus sp.
RNYEYYASHVPESVKN

SEQ ID NO: 9668 - protein, 15 aa, Mus sp.
EAGAYDGPRTADGIV

SEQ ID NO: 9669 - protein, 14 aa, Mus sp.
KEDRRYNPPIIHQG

SEQ ID NO: 9670 - protein, 24 aa, Mus sp.
WSFMGALSVVLPCLLCYLPATGCV

SEQ ID NO: 9671 - protein, 14 aa, Mus sp.
QKAMFDHLSYLLEN

SEQ ID NO: 9672 - protein, 21 aa, Mus sp.
DPGESKSYSYSEVLPTEGPPS

SEQ ID NO: 9673 - protein, 22 aa, Mus sp.
DPAGPNFEYAEAPSRLSPDDAD

SEQ ID NO: 9674 - protein, 16 aa, Mus sp.
EKYVTSAPMPEPGAPG

SEQ ID NO: 9675 - protein, 16 aa, Mus sp.
VDMARVVAPFMSNIPL

SEQ ID NO: 9676 - protein, 16 aa, Mus sp.
KFRFEEPVVLPDLSDQ

SEQ ID NO: 9677 - protein, 14 aa, Mus sp.
DYLKWLFPTSMRSN

SEQ ID NO: 9678 - protein, 15 aa, Mus sp.
GLPDYSAPNPIKVTH

SEQ ID NO: 9679 - protein, 15 aa, Mus sp.
VMDAYTSAVSLSATG

SEQ ID NO: 9680 - protein, 21 aa, Mus sp.
LPEGDISISGPKVNVEAPNVN

SEQ ID NO: 9681 - protein, 26 aa, Mus sp.
EKWEETELDQLFSGPLPGRLPVNHRP

SEQ ID NO: 9682 - protein, 19 aa, Mus sp.
ALEDPDGFSWPATLPSVYK

SEQ ID NO: 9683 - protein, 15 aa, Mus sp.
GNSEFDPPGPNVATT

SEQ ID NO: 9684 - protein, 16 aa, Mus sp.
HIEVWERPLSNLAWAV

SEQ ID NO: 9685 - protein, 15 aa, Mus sp.
SKIRYKTSEPVWEEN

SEQ ID NO: 9686 - protein, 17 aa, Mus sp.
TTSSYSNPTIGYENRVL

SEQ ID NO: 9687 - protein, 15 aa, Mus sp.
STLIWAAPRLQSEVA

SEQ ID NO: 9688 - protein, 12 aa, Mus sp.
YEWAPPVQNQAL

SEQ ID NO: 9689 - protein, 18 aa, Mus sp.
EEKPVPAAPVPSPVAPAP

SEQ ID NO: 9690 - protein, 16 aa, Mus sp.
QPVVIYSSPGVILPKQ

SEQ ID NO: 9691 - protein, 13 aa, Mus sp.
QREEYQPATPGLG

SEQ ID NO: 9692 - protein, 18 aa, Mus sp.
NHIEVWERPLSNLAWAVA

SEQ ID NO: 9693 - protein, 15 aa, Mus sp.
APNLHFHNPNPEIPA

SEQ ID NO: 9694 - protein, 15 aa, Mus sp.
DTIEFRGPNGLLVYQ

SEQ ID NO: 9695 - protein, 23 aa, Mus sp.
NPEPPPPRSHYSNIEANESEEVR

SEQ ID NO: 9696 - protein, 12 aa, Mus sp.
HTLFHNPHVNPL

SEQ ID NO: 9697 - protein, 16 aa, Mus sp.
IQRVQAMKSPDHNGED

SEQ ID NO: 9698 - protein, 13 aa, Mus sp.
LRDNYRFAHTNIE

SEQ ID NO: 9699 - protein, 16 aa, Mus sp.
HTVSFVQPNGAIFEPS

SEQ ID NO: 9700 - protein, 16 aa, Mus sp.
TKGNPARWRDFHSATM

SEQ ID NO: 9701 - protein, 17 aa, Mus sp.
IESKEAFQEALAAAGDK

SEQ ID NO: 9702 - protein, 19 aa, Mus sp.
TPSPESPDQWSSSSPHSAS

SEQ ID NO: 9703 - protein, 16 aa, Mus sp.
APKETTIWVSPSPILE

SEQ ID NO: 9704 - protein, 15 aa, Mus sp.
EQRATFHTPEAPPNL

SEQ ID NO: 9705 - protein, 26 aa, Mus sp.
ITGLDPAGPNFEYAEAPSRLSPDDAD

SEQ ID NO: 9706 - protein, 20 aa, Mus sp.
APSNYLNNPYVRKALHIPES

SEQ ID NO: 9707 - protein, 17 aa, Mus sp.
AEIEYAMAYSKAAFERE

SEQ ID NO: 9708 - protein, 13 aa, Mus sp.
YPYIPAHITKPKE

SEQ ID NO: 9709 - protein, 15 aa, Mus sp.
LEALVGPEANVGPYG

SEQ ID NO: 9710 - protein, 8 aa, Mus sp.
AVYAFLGL

SEQ ID NO: 9711 - protein, 22 aa, Mus sp.
DESGFPKPPSYNVATTLPSYDE

SEQ ID NO: 9712 - protein, 15 aa, Mus sp.
TNTAYVGSAILSEET

SEQ ID NO: 9713 - protein, 17 aa, Mus sp.
DEQEFVYKEPAITKLPE

SEQ ID NO: 9714 - protein, 18 aa, Mus sp.
GRIEHLYKNPQAHIEGNM

SEQ ID NO: 9715 - protein, 15 aa, Mus sp.
LNLAYIGAVPHSGIE

SEQ ID NO: 9716 - protein, 18 aa, Mus sp.
EAPSIFLDPETRQAMGEQ

SEQ ID NO: 9717 - protein, 18 aa, Mus sp.
TGMAFRVPTPNVSVVDLT

SEQ ID NO: 9718 - protein, 14 aa, Mus sp.
KPFQNPVPNQSPSS

SEQ ID NO: 9719 - protein, 16 aa, Mus sp.
DDARVYHDPSTQEPVT

SEQ ID NO: 9720 - protein, 13 aa, Mus sp.
LDNYDAPDIANIA

SEQ ID NO: 9721 - protein, 20 aa, Mus sp.
TPSSPSYSPSSPSYSPTSPK

SEQ ID NO: 9722 - protein, 19 aa, Mus sp.
SPSSPEYTPASPKYSPTSP

SEQ ID NO: 9723 - protein, 19 aa, Mus sp.
DPAVADLVKNPTASLVLPE

SEQ ID NO: 9724 - protein, 20 aa, Mus sp.
DDGHGGYKPFQNPVPNQSPS

SEQ ID NO: 9725 - protein, 17 aa, Mus sp.
GDTIEFRGPNGLLVYQG

SEQ ID NO: 9726 - protein, 14 aa, Mus sp.
ETFHASQPSLTVDG

SEQ ID NO: 9727 - protein, 15 aa, Mus sp.
AINDYKGAVIVVSHD

SEQ ID NO: 9728 - protein, 18 aa, Mus sp.
LDKDSFSDPYAHVSFLHR

SEQ ID NO: 9729 - protein, 13 aa, Mus sp.
IVKYELPLVIKAL

SEQ ID NO: 9730 - protein, 17 aa, Mus sp.
AAPASAPTPSTPAPTPA

SEQ ID NO: 9731 - protein, 20 aa, Mus sp.
GPPGFEDYVELPPSVSQAAK

SEQ ID NO: 9732 - protein, 14 aa, Mus sp.
ASVGAWTGPMGNWA

SEQ ID NO: 9733 - protein, 13 aa, Mus sp.
EDNWSLPNRAVEP

SEQ ID NO: 9734 - protein, 15 aa, Mus sp.
MAFRVPTPNVSVVDL

SEQ ID NO: 9735 - protein, 14 aa, Mus sp.
KLISFSPTVNTSVS

SEQ ID NO: 9736 - protein, 14 aa, Mus sp.
FIVKYELPLVIKAL

SEQ ID NO: 9737 - protein, 10 aa, Mus sp.
TPDYIAPEII

SEQ ID NO: 9738 - protein, 17 aa, Mus sp.
DSRTNTAYVGSAILSEE

SEQ ID NO: 9739 - protein, 14 aa, Mus sp.
APVPSPVAPAPVPS

SEQ ID NO: 9740 - protein, 14 aa, Mus sp.
DVDFDFAGPAIHGS

SEQ ID NO: 9741 - protein, 18 aa, Mus sp.
SGAVIFNFPGTRNEVIPM

SEQ ID NO: 9742 - protein, 15 aa, Mus sp.
RITPSYVAFTPEGER

SEQ ID NO: 9743 - protein, 17 aa, Mus sp.
IEEIEVAPPKAHEVRIK

SEQ ID NO: 9744 - protein, 16 aa, Mus sp.
LSLDWHPNNVLLAAGS

SEQ ID NO: 9745 - protein, 16 aa, Mus sp.
VLPANAFASPLQNPDN

SEQ ID NO: 9746 - protein, 16 aa, Mus sp.
EYQQYQDATAEEEGEF

SEQ ID NO: 9747 - protein, 18 aa, Mus sp.
DGLNLDWQYPGSRGSPPK

SEQ ID NO: 9748 - protein, 16 aa, Mus sp.
FELPYVSVTSLRSQEY

SEQ ID NO: 9749 - protein, 14 aa, Mus sp.
AGGHKVGLGFELEA

SEQ ID NO: 9750 - protein, 16 aa, Mus sp.
VKQYYEVPIAMKSVFD

SEQ ID NO: 9751 - protein, 16 aa, Mus sp.
LDLLDLAPEPRYAHIP

SEQ ID NO: 9752 - protein, 13 aa, Mus sp.
DLWGPGARVAADS

SEQ ID NO: 9753 - protein, 16 aa, Mus sp.
IEVDQIYHLASPASPP

SEQ ID NO: 9754 - protein, 13 aa, Mus sp.
ELWDSPEPASAPR

SEQ ID NO: 9755 - protein, 12 aa, Mus sp.
VEYEASAAGLIR

SEQ ID NO: 9756 - protein, 20 aa, Mus sp.
EPSKLKRSYSSPDITQALQE

SEQ ID NO: 9757 - protein, 15 aa, Mus sp.
ITGVDFIGSTVGLAK

SEQ ID NO: 9758 - protein, 17 aa, Mus sp.
APSNTFVAPQPVVASPA

SEQ ID NO: 9759 - protein, 16 aa, Mus sp.
DTVTISGPQAAVNEFV

SEQ ID NO: 9760 - protein, 19 aa, Mus sp.
DPTPDPNTAYASYPSASVE

SEQ ID NO: 9761 - protein, 14 aa, Mus sp.
EVNSQYQEPDIIIH

SEQ ID NO: 9762 - protein, 17 aa, Mus sp.
VGPVPWLGPQTDEAIKG

SEQ ID NO: 9763 - protein, 13 aa, Mus sp.
LPSTWSDPSVNIS

SEQ ID NO: 9764 - protein, 16 aa, Mus sp.
FPIKWTAPEAALYGRF

SEQ ID NO: 9765 - protein, 13 aa, Mus sp.
EVWERPLSNLAWA

SEQ ID NO: 9766 - protein, 8 aa, Mus sp.
SVYSFLFL

SEQ ID NO: 9767 - protein, 16 aa, Mus sp.
DPTNPFRFPNIGVEKF

SEQ ID NO: 9768 - protein, 15 aa, Mus sp.
DMDGEWEAPQIANPK

SEQ ID NO: 9769 - protein, 16 aa, Mus sp.
LKRSYSSPDITQALQE

SEQ ID NO: 9770 - protein, 16 aa, Mus sp.
GIPVYRFVLPANAFAS

SEQ ID NO: 9771 - protein, 17 aa, Mus sp.
TVKSFVGPTPAPAPAPR

SEQ ID NO: 9772 - protein, 15 aa, Mus sp.
TVTPWKAPIVWEGTY

SEQ ID NO: 9773 - protein, 19 aa, Mus sp.
TETKVEPYEVHNPVPLIVG

SEQ ID NO: 9774 - protein, 17 aa, Mus sp.
DMFHYTSTTTKVPPPDT

SEQ ID NO: 9775 - protein, 19 aa, Mus sp.
NPQMPQYTSPQPGSALSPR

SEQ ID NO: 9776 - protein, 16 aa, Mus sp.
TIFQHHFPAAIDSFQD

SEQ ID NO: 9777 - protein, 15 aa, Mus sp.
FSYAVFGPRVASGDL

SEQ ID NO: 9778 - protein, 13 aa, Mus sp.
GPPIFNPVANEVY

SEQ ID NO: 9779 - protein, 17 aa, Mus sp.
NPDEAVAYGAAVQAAIL

SEQ ID NO: 9780 - protein, 15 aa, Mus sp.
SMRYFETAVSRPGLE

SEQ ID NO: 9781 - protein, 12 aa, Mus sp.
MKNKELIPLAFF

SEQ ID NO: 9782 - protein, 16 aa, Mus sp.
EVKAFFESHPAPSAER

SEQ ID NO: 9783 - protein, 14 aa, Mus sp.
RDNMFSGSKINYTE

SEQ ID NO: 9784 - protein, 18 aa, Mus sp.
DEAQVEFMASHGNEAARA

SEQ ID NO: 9785 - protein, 18 aa, Mus sp.
RPVKESYSGPSTALTYPS

SEQ ID NO: 9786 - protein, 15 aa, Mus sp.
KTPEIVAPESAHAAF

SEQ ID NO: 9787 - protein, 17 aa, Mus sp.
TVTPWKAPIVWEGTYDT

SEQ ID NO: 9788 - protein, 19 aa, Mus sp.
APGRDLHYQNPHSNAVGNP

SEQ ID NO: 9789 - protein, 17 aa, Mus sp.
DGELTYENVQVSPVPGG

SEQ ID NO: 9790 - protein, 14 aa, Mus sp.
FDFAGPAIHGSAVF

SEQ ID NO: 9791 - protein, 14 aa, Mus sp.
SPHPYQLPQALAPH

SEQ ID NO: 9792 - protein, 16 aa, Mus sp.
LKPVWYSPKVFIEGAD

SEQ ID NO: 9793 - protein, 15 aa, Mus sp.
VSVEFIAPTLEGTYT

SEQ ID NO: 9794 - protein, 16 aa, Mus sp.
LNLEYHSSMIADAVKK

SEQ ID NO: 9795 - protein, 18 aa, Mus sp.
AGEFDYSGSQAIKALKEE

SEQ ID NO: 9796 - protein, 14 aa, Mus sp.
DRKIVYEGPELNHA

SEQ ID NO: 9797 - protein, 15 aa, Mus sp.
INDYKGAVIVVSHDA

SEQ ID NO: 9798 - protein, 16 aa, Mus sp.
WHIQADHAYQALPSFQ

SEQ ID NO: 9799 - protein, 18 aa, Mus sp.
DERFGVRFPAMSDAYDRD

SEQ ID NO: 9800 - protein, 15 aa, Mus sp.
AGPQWADPQISESNF

SEQ ID NO: 9801 - protein, 17 aa, Mus sp.
VPPSVSPSPATAFSGPP

SEQ ID NO: 9802 - protein, 15 aa, Mus sp.
FQFGYNTGVINAPET

SEQ ID NO: 9803 - protein, 15 aa, Mus sp.
LPVKWTAPEALREKK

SEQ ID NO: 9804 - protein, 14 aa, Mus sp.
YLPYKSPGINVDSS

SEQ ID NO: 9805 - protein, 17 aa, Mus sp.
GTPEYLAPEIILSKGYN

SEQ ID NO: 9806 - protein, 17 aa, Mus sp.
AVKSKYKASIAALEAKI

SEQ ID NO: 9807 - protein, 21 aa, Mus sp.
LDPAGPNFEYAEAPSRLSPDD

SEQ ID NO: 9808 - protein, 19 aa, Mus sp.
IGDSNFGAPSASVAAAPAP

SEQ ID NO: 9809 - protein, 18 aa, Mus sp.
IESKEAFQEALAAAGDKL

SEQ ID NO: 9810 - protein, 16 aa, Mus sp.
VTEDNVFEAPTLVKVF

SEQ ID NO: 9811 - protein, 18 aa, Mus sp.
GQDHVDFSQPEPHTVLFH

SEQ ID NO: 9812 - protein, 16 aa, Mus sp.
LRDMYSKSSAAMSTYA

SEQ ID NO: 9813 - protein, 16 aa, Mus sp.
KNVTELNEPLSNEERN

SEQ ID NO: 9814 - protein, 17 aa, Mus sp.
SPPGGDFSDPVTSATLG

SEQ ID NO: 9815 - protein, 13 aa, Mus sp.
EVYTFPVPERHLE

SEQ ID NO: 9816 - protein, 22 aa, Mus sp.
EMEKEDRRYNPPIIHQGFQDTS

SEQ ID NO: 9817 - protein, 17 aa, Mus sp.
ASLEDFYGSPIPSVSLK

SEQ ID NO: 9818 - protein, 16 aa, Mus sp.
EPRVLPYHPAQPGQAT

SEQ ID NO: 9819 - protein, 18 aa, Mus sp.
GDLSWHPALTTKSKMRDP

SEQ ID NO: 9820 - protein, 20 aa, Mus sp.
FAAEEFKVPAATSAIITNDG

SEQ ID NO: 9821 - protein, 15 aa, Mus sp.
TSSYYRGAHGIIVVY

SEQ ID NO: 9822 - protein, 15 aa, Mus sp.
SFFWNVAPGAESAVA

SEQ ID NO: 9823 - protein, 18 aa, Mus sp.
LPETFRRPQIDPAVEGFI

SEQ ID NO: 9824 - protein, 16 aa, Mus sp.
AARDNMFSGSKINYTE

SEQ ID NO: 9825 - protein, 15 aa, Mus sp.
KKWVNTPFTASSIEL

SEQ ID NO: 9826 - protein, 16 aa, Mus sp.
GAQEMVSSSVSSAKET

SEQ ID NO: 9827 - protein, 23 aa, Mus sp.
LDPAGPNFEYAEAPSRLSPDDAD

SEQ ID NO: 9828 - protein, 18 aa, Mus sp.
GPAGPGAVEGPNPASSPD

SEQ ID NO: 9829 - protein, 16 aa, Mus sp.
YVELPPSVSQAAKSPP

SEQ ID NO: 9830 - protein, 13 aa, Mus sp.
VYHEPHIADAWPQ

SEQ ID NO: 9831 - protein, 19 aa, Mus sp.
DTGENPIYKSAVTTVVNPK

SEQ ID NO: 9832 - protein, 14 aa, Mus sp.
DKFWGPSGAESVIG

SEQ ID NO: 9833 - protein, 15 aa, Mus sp.
TIEFRGPNGLLVYQG

SEQ ID NO: 9834 - protein, 17 aa, Mus sp.
YLPETFRRPQIDPAVEG

SEQ ID NO: 9835 - protein, 16 aa, Mus sp.
GDTHFDSAEPWTVQNE

SEQ ID NO: 9836 - protein, 18 aa, Mus sp.
FPTLKFFPASADRTVIDY

SEQ ID NO: 9837 - protein, 17 aa, Mus sp.
FKHAVSDPSILDSLDLN

SEQ ID NO: 9838 - protein, 16 aa, Mus sp.
VLIPYQGPSSDYVVVK

SEQ ID NO: 9839 - protein, 21 aa, Mus sp.
CALLTLRWPRPLTTLATAVTG

SEQ ID NO: 9840 - protein, 16 aa, Mus sp.
FPGAQHYVGGNAALIG

SEQ ID NO: 9841 - protein, 17 aa, Mus sp.
FWPPVTNTEMFVTAPDN

SEQ ID NO: 9842 - protein, 16 aa, Mus sp.
GTVIHFNNPKVQASLA

SEQ ID NO: 9843 - protein, 18 aa, Mus sp.
SPTGNIFFSPFSISSALA

SEQ ID NO: 9844 - protein, 18 aa, Mus sp.
DGTVIHFNNPKVQASLSA

SEQ ID NO: 9845 - protein, 16 aa, Mus sp.
SNPSYNYEIVNRASLA

SEQ ID NO: 9846 - protein, 15 aa, Mus sp.
APMYYRGAQAAIVVY

SEQ ID NO: 9847 - protein, 16 aa, Mus sp.
IDWTYRPPSSSRTESI

SEQ ID NO: 9848 - protein, 19 aa, Mus sp.
KGADKTVKGPDGLTALEAT

SEQ ID NO: 9849 - protein, 17 aa, Mus sp.
YKKELEEQLGPVAEETR

SEQ ID NO: 9850 - protein, 17 aa, Mus sp.
GTVDVVLTPLVAEALDR

SEQ ID NO: 9851 - protein, 19 aa, Mus sp.
SAPVEGASPTSISAVDGLT

SEQ ID NO: 9852 - protein, 13 aa, Mus sp.
IKVYWDAPSPAPD

SEQ ID NO: 9853 - protein, 15 aa, Mus sp.
EDYVELPPSVSQAAK

SEQ ID NO: 9854 - protein, 16 aa, Mus sp.
DSPDVVYSPETIEARY

SEQ ID NO: 9855 - protein, 26 aa, Mus sp.
GNPTVEVDLYTAKGLFRAAVPSGAST

SEQ ID NO: 9856 - protein, 19 aa, Mus sp.
GPAGPGAVEGPNPASSPDA

SEQ ID NO: 9857 - protein, 13 aa, Mus sp.
GTPDYIAPEILQG

SEQ ID NO: 9858 - protein, 15 aa, Mus sp.
RDGDSYRSPWSNKYD

SEQ ID NO: 9859 - protein, 15 aa, Mus sp.
WDRKMYYASKAMPAE

SEQ ID NO: 9860 - protein, 16 aa, Mus sp.
QIPKVVKSPSSLPAKP

SEQ ID NO: 9861 - protein, 21 aa, Mus sp.
APKETTIWVSPSPILEEGSPV

SEQ ID NO: 9862 - protein, 15 aa, Mus sp.
IDWTYRPPSSSRTES

SEQ ID NO: 9863 - protein, 18 aa, Mus sp.
KPDSLMGAPSAMVSFYPD

SEQ ID NO: 9864 - protein, 18 aa, Mus sp.
WSDAAAPFAGLSTDQTLR

SEQ ID NO: 9865 - protein, 15 aa, Mus sp.
GPGGLWVWGAPAVAQ

SEQ ID NO: 9866 - protein, 19 aa, Mus sp.
LPGNLDYWTYPGSLTTPPL

SEQ ID NO: 9867 - protein, 15 aa, Mus sp.
ALVVTTPQAVSIGDV

SEQ ID NO: 9868 - protein, 15 aa, Mus sp.
DPTFHTPLDLYAYAR

SEQ ID NO: 9869 - protein, 25 aa, Mus sp.
GPSAPATPAAEAKAAEAAASAYYNP

SEQ ID NO: 9870 - protein, 16 aa, Mus sp.
AVPPVFTQPTANIMPS

SEQ ID NO: 9871 - protein, 18 aa, Mus sp.
TPAPTPAATPAASPAPVS

SEQ ID NO: 9872 - protein, 14 aa, Mus sp.
VEALEQPAPAIVSA

SEQ ID NO: 9873 - protein, 17 aa, Mus sp.
GPVPEFSGATVERVSED

SEQ ID NO: 9874 - protein, 23 aa, Mus sp.
KPTVTVVSPLPNDSINPQPSPDG

SEQ ID NO: 9875 - protein, 27 aa, Mus sp.
KVIPELNGKLTGMAFRVPTPNVSVVDL

SEQ ID NO: 9876 - protein, 22 aa, Mus sp.
AVNKGFYKEATQLWGKAEMIIE

SEQ ID NO: 9877 - protein, 16 aa, Mus sp.
EAGAYDGPRTADGIVS

SEQ ID NO: 9878 - protein, 13 aa, Mus sp.
YAVEKNPNAVVTL

SEQ ID NO: 9879 - protein, 21 aa, Mus sp.
VDPTPDPNTAYASYPSASVEN

SEQ ID NO: 9880 - protein, 15 aa, Mus sp.
LLYNVPAVAEEIQDE

SEQ ID NO: 9881 - protein, 16 aa, Mus sp.
LDDPIWRGPLPSNGVM

SEQ ID NO: 9882 - protein, 16 aa, Mus sp.
VFPEFAAAHSNLASVL

SEQ ID NO: 9883 - protein, 17 aa, Mus sp.
KTPESFLGPNAALVDLD

SEQ ID NO: 9884 - protein, 16 aa, Mus sp.
LLEAKGPVTDVAYSHD

SEQ ID NO: 9885 - protein, 24 aa, Mus sp.
APAPAAPAAAEPQAEAPAAAASSE

SEQ ID NO: 9886 - protein, 16 aa, Mus sp.
ADDTYTESYISTIGVD

SEQ ID NO: 9887 - protein, 15 aa, Mus sp.
LAETVAPAVRGANPH

SEQ ID NO: 9888 - protein, 15 aa, Mus sp.
VPAPATTPAPTPAPA

SEQ ID NO: 9889 - protein, 18 aa, Mus sp.
VGGERFEAPEALFQPHLI

SEQ ID NO: 9890 - protein, 13 aa, Mus sp.
TVHWVAPRAPITG

SEQ ID NO: 9891 - protein, 20 aa, Listeria monocytogenes
VWTKPNKIEGAQKISALSTY

SEQ ID NO: 9892 - protein, 17 aa, Mus sp.
AINDYKGAVIVVSHDAR

SEQ ID NO: 9893 - protein, 15 aa, Mus sp.
VGVNEYGLPMAVAQV

SEQ ID NO: 9894 - protein, 17 aa, Mus sp.
INMKQYASPMPTQTDVK

SEQ ID NO: 9895 - protein, 14 aa, Mus sp.
SEVYTFPVPERHLE

SEQ ID NO: 9896 - protein, 15 aa, Mus sp.
NPLNSVFVAPAVTPV

SEQ ID NO: 9897 - protein, 17 aa, Mus sp.
ESLHLRFSAPQIENEPE

SEQ ID NO: 9898 - protein, 16 aa, Mus sp.
YVELPPSVSQAATSPP

SEQ ID NO: 9899 - protein, 16 aa, Mus sp.
LDIYVWRGAQATLSNT

SEQ ID NO: 9900 - protein, 18 aa, Mus sp.
IHKSFVEVNEEGTEAAAA

SEQ ID NO: 9901 - protein, 14 aa, Mus sp.
VDFDFAGPAIHGSA

SEQ ID NO: 9902 - protein, 19 aa, Mus sp.
EDGDMRLVNGASANEGRVE

SEQ ID NO: 9903 - protein, 16 aa, Mus sp.
KVEPYEVHNPVPLIVG

SEQ ID NO: 9904 - protein, 16 aa, Mus sp.
SHPQYAEPGAEAAFSG

SEQ ID NO: 9905 - protein, 16 aa, Mus sp.
YQMYGGPVVLVAHSMG

SEQ ID NO: 9906 - protein, 16 aa, Mus sp.
LIDQCSHFEESLIKNL

SEQ ID NO: 9907 - protein, 16 aa, Mus sp.
FKHAVSDPSILDSLDL

SEQ ID NO: 9908 - protein, 17 aa, Mus sp.
EPSKYYYEVSLPSGLEE

SEQ ID NO: 9909 - protein, 19 aa, Mus sp.
DPEDHTVSFVQPNGAIFEP

SEQ ID NO: 9910 - protein, 17 aa, Mus sp.
KPGTTVEYLAPWANQID

SEQ ID NO: 9911 - protein, 14 aa, Mus sp.
YLNEYGAPDAGGLE

SEQ ID NO: 9912 - protein, 14 aa, Mus sp.
EVEHWFYPQENIID

SEQ ID NO: 9913 - protein, 16 aa, Mus sp.
VSTLIWAAPRLQSEVA

SEQ ID NO: 9914 - protein, 12 aa, Mus sp.
EDFYGSPIPSVS

SEQ ID NO: 9915 - protein, 13 aa, Mus sp.
DFYGSPIPSVSLK

SEQ ID NO: 9916 - protein, 16 aa, Mus sp.
AKVELVPPTPAEIPTA

SEQ ID NO: 9917 - protein, 17 aa, Mus sp.
VLDNYLTSPLPEEVDET

SEQ ID NO: 9918 - protein, 18 aa, Mus sp.
APVEGASPTSISAVDGLT

SEQ ID NO: 9919 - protein, 19 aa, Mus sp.
VPVPEFADSDPANIVHDFN

SEQ ID NO: 9920 - protein, 14 aa, Mus sp.
GDIFIGPKAEEHRG

SEQ ID NO: 9921 - protein, 16 aa, Mus sp.
VLPTYDASKVTASGPG

SEQ ID NO: 9922 - protein, 16 aa, Mus sp.
GIPYFETSAANGTNIS

SEQ ID NO: 9923 - protein, 15 aa, Mus sp.
TGVDFIGSTVGLAKV

SEQ ID NO: 9924 - protein, 16 aa, Mus sp.
EGPYYVKPVATTAVEG

SEQ ID NO: 9925 - protein, 18 aa, Mus sp.
SADDFFQGTKAALAGGTT

SEQ ID NO: 9926 - protein, 27 aa, Mus sp.
GNPTVEVDLYTAKGLFRAAVPSGASTG

SEQ ID NO: 9927 - protein, 17 aa, Mus sp.
DIDTAAKFIGAGAATVG

SEQ ID NO: 9928 - protein, 14 aa, Mus sp.
GDLEYQMSTTARAK

SEQ ID NO: 9929 - protein, 16 aa, Mus sp.
APMYYRGSAAAIIVYD

SEQ ID NO: 9930 - protein, 16 aa, Mus sp.
SPVSETVVTPEAAPEK

SEQ ID NO: 9931 - protein, 16 aa, Mus sp.
KEVDRYDAPGIAFYPG

SEQ ID NO: 9932 - protein, 14 aa, Mus sp.
LDWQYPGSRGSPPK

SEQ ID NO: 9933 - protein, 14 aa, Mus sp.
EVGEYRQPSGGSVP

SEQ ID NO: 9934 - protein, 18 aa, Mus sp.
KFGNSEFDPPGPNVATTT

SEQ ID NO: 9935 - protein, 16 aa, Mus sp.
DIRSDWTNPEINKAVL

SEQ ID NO: 9936 - protein, 19 aa, Mus sp.
FEDYVELPPSVSQAATSPP

SEQ ID NO: 9937 - protein, 18 aa, Mus sp.
EDYVELPPSVSQAATSPP

SEQ ID NO: 9938 - protein, 15 aa, Mus sp.
GTPEYLAPEVIQSKG

SEQ ID NO: 9939 - protein, 19 aa, Mus sp.
APGKKVIYSQPSTRSEGEF

SEQ ID NO: 9940 - protein, 13 aa, Mus sp.
NNPWVTPIADQFQ

SEQ ID NO: 9941 - protein, 17 aa, Mus sp.
APQQAAAPEPTSAFNPR

SEQ ID NO: 9942 - protein, 17 aa, Mus sp.
GRPDAEYWNSQPEILER

SEQ ID NO: 9943 - protein, 13 aa, Mus sp.
DVDFDFAGPAIHG

SEQ ID NO: 9944 - protein, 15 aa, Mus sp.
LKDREQHMFKISALE

SEQ ID NO: 9945 - protein, 13 aa, Mus sp.
KNLDYVATSIHEA

SEQ ID NO: 9946 - protein, 16 aa, Mus sp.
YYNEVHSPSVAVEMGM

SEQ ID NO: 9947 - protein, 18 aa, Mus sp.
FPKTNATSPGVNSSASPQ

SEQ ID NO: 9948 - protein, 15 aa, Mus sp.
YALVYTSPVIPELKL

SEQ ID NO: 9949 - protein, 13 aa, Mus sp.
LPDYSAPNPIKVT

SEQ ID NO: 9950 - protein, 14 aa, Mus sp.
SSKNVFLSPMSISS

SEQ ID NO: 9951 - protein, 17 aa, Mus sp.
EDGELTYENVQVSPVPG

SEQ ID NO: 9952 - protein, 15 aa, Mus sp.
TSPSYSPTSPNYSPT

SEQ ID NO: 9953 - protein, 17 aa, Mus sp.
TPAAPTSALGPKASPAP

SEQ ID NO: 9954 - protein, 18 aa, Mus sp.
KPGTTVEYLAPWANQIDM

SEQ ID NO: 9955 - protein, 16 aa, Mus sp.
SAPPHFHFGQTNRTPE

SEQ ID NO: 9956 - protein, 21 aa, Mus sp.
EKWEETELDQLFSGPLPGRLP

SEQ ID NO: 9957 - protein, 21 aa, Mus sp.
DPETSVLILRKPGVSVASDWS

SEQ ID NO: 9958 - protein, 15 aa, Mus sp.
RASIYQSVVINTSKE

SEQ ID NO: 9959 - protein, 16 aa, Mus sp.
HKAFLEVNEEGSEAAA

SEQ ID NO: 9960 - protein, 14 aa, Mus sp.
DAIQFATGMANALE

SEQ ID NO: 9961 - protein, 18 aa, Mus sp.
GTDRKIVYEGPELNHAFG

SEQ ID NO: 9962 - protein, 16 aa, Mus sp.
AQTAYSANPASQAFVL

SEQ ID NO: 9963 - protein, 14 aa, Mus sp.
GQVYAFPSSQSVTE

SEQ ID NO: 9964 - protein, 12 aa, Mus sp.
RLNSPVTIPAVM

SEQ ID NO: 9965 - protein, 14 aa, Mus sp.
ELEEQLGPVAEETR

SEQ ID NO: 9966 - protein, 13 aa, Mus sp.
VELPPSVSQAATS

SEQ ID NO: 9967 - protein, 17 aa, Mus sp.
VDLPNYSSPNALVLNTK

SEQ ID NO: 9968 - protein, 12 aa, Mus sp.
GTPDYIAPEILQ

SEQ ID NO: 9969 - protein, 14 aa, Mus sp.
INPEEYEHPNPWKE

SEQ ID NO: 9970 - protein, 21 aa, Mus sp.
YPPPPQSDSASSPSPSFSEDN

SEQ ID NO: 9971 - protein, 17 aa, Mus sp.
IGNERFRCPEAIFQPSF

SEQ ID NO: 9972 - protein, 15 aa, Mus sp.
ISNYGFPRSVQAIDA

SEQ ID NO: 9973 - protein, 16 aa, Mus sp.
EVAQLISPVTTASMSG

SEQ ID NO: 9974 - protein, 24 aa, Mus sp.
DESGFPKPPSYNVATTLPSYDEAE

SEQ ID NO: 9975 - protein, 18 aa, Listeria monocytogenes
GTKEKVVATPVSNVSTSS

SEQ ID NO: 9976 - protein, 21 aa, Mus sp.
SDEGERYIAPTVLVDVQETEP

SEQ ID NO: 9977 - protein, 13 aa, Mus sp.
TGMAFRVPTPNVS

SEQ ID NO: 9978 - protein, 15 aa, Mus sp.
RDNMFSGSKINYTEN

SEQ ID NO: 9979 - protein, 15 aa, Mus sp.
EGSYEAAKILLDHFA

SEQ ID NO: 9980 - protein, 17 aa, Mus sp.
IGFRYVHPLTEEAIEEM

SEQ ID NO: 9981 - protein, 16 aa, Mus sp.
DDDFEPYLSPQARPNN

SEQ ID NO: 9982 - protein, 15 aa, Mus sp.
GDLSQHATPLPTPAV

SEQ ID NO: 9983 - protein, 15 aa, Mus sp.
DPSAFAAAAPAAAAT

SEQ ID NO: 9984 - protein, 17 aa, Mus sp.
KPEDYQGGRTGEAIVDA

SEQ ID NO: 9985 - protein, 17 aa, Mus sp.
GTPEYLAPEVLEDNDYG

SEQ ID NO: 9986 - protein, 17 aa, Mus sp.
GEFDYSGSQAIKALKEE

SEQ ID NO: 9987 - protein, 17 aa, Mus sp.
LPPHVYSTPQPSLPPVQ

SEQ ID NO: 9988 - protein, 15 aa, Mus sp.
SSPYNPPDLEEAAKT

SEQ ID NO: 9989 - protein, 21 aa, Mus sp.
REPPPAYEPPAPAPAPLPPPS

SEQ ID NO: 9990 - protein, 23 aa, Mus sp.
PGIDGIPGEKGNAGDIGGPGPPG

SEQ ID NO: 9991 - protein, 15 aa, Mus sp.
KPEDYQGGRTGEAIV

SEQ ID NO: 9992 - protein, 17 aa, Mus sp.
TTTVVHAPYPQPQPQPV

SEQ ID NO: 9993 - protein, 17 aa, Mus sp.
YAVDIRSPAISWVNNLE

SEQ ID NO: 9994 - protein, 16 aa, Mus sp.
LPFGAYTNPFATPAQA

SEQ ID NO: 9995 - protein, 18 aa, Mus sp.
DPDSRGEYSWAVAQGVKQ

SEQ ID NO: 9996 - protein, 15 aa, Mus sp.
KDSFSDPYAHVSFLH

SEQ ID NO: 9997 - protein, 14 aa, Mus sp.
VRVDEYDYSKPIQG

SEQ ID NO: 9998 - protein, 16 aa, Mus sp.
KPSPIYISSYSSPARE

SEQ ID NO: 9999 - protein, 18 aa, Mus sp.
ESKATYSTNSPVWEEAFR

SEQ ID NO: 10000 - protein, 15 aa, Mus sp.
VTYEWAPPVQNQALA

SEQ ID NO: 10001 - protein, 14 aa, Mus sp.
VQWNDPGAQYSLVN

SEQ ID NO: 10002 - protein, 15 aa, Mus sp.
TTTWQRPTAEYVRNY

SEQ ID NO: 10003 - protein, 14 aa, Mus sp.
KPTVTVVSPLPNDS

SEQ ID NO: 10004 - protein, 13 aa, Mus sp.
VGAWTGPMGNWAM

SEQ ID NO: 10005 - protein, 19 aa, Mus sp.
DVKKPAAAPAPAPAPAPAP

SEQ ID NO: 10006 - protein, 15 aa, Mus sp.
EFDYSGSQAIKALKE

SEQ ID NO: 10007 - protein, 17 aa, Mus sp.
KGQDHVDFSQPEPHTVL

SEQ ID NO: 10008 - protein, 14 aa, Mus sp.
LQVYAPEVSPESIM

SEQ ID NO: 10009 - protein, 16 aa, Mus sp.
DKRLEFEASQVLGTMD

SEQ ID NO: 10010 - protein, 17 aa, Mus sp.
GGDTHFDSAEPWTVQNE

SEQ ID NO: 10011 - protein, 18 aa, Mus sp.
KPTVTVVSPLPNDSINPQ

SEQ ID NO: 10012 - protein, 14 aa, Mus sp.
EEKYHEALAKGDVT

SEQ ID NO: 10013 - protein, 16 aa, Mus sp.
IGRTWNDPSVQQDIKF

SEQ ID NO: 10014 - protein, 15 aa, Mus sp.
IEHLYKNPQAHIEGN

SEQ ID NO: 10015 - protein, 16 aa, Mus sp.
ESKATYSTNSPVWEEA

SEQ ID NO: 10016 - protein, 18 aa, Mus sp.
LPDSWASGYAVPVVTVVR

SEQ ID NO: 10017 - protein, 25 aa, Mus sp.
ASFDPQGGLQNIAVVKHNLGVLTKR

SEQ ID NO: 10018 - protein, 16 aa, Mus sp.
GPYDFYQHPNVAEARQ

SEQ ID NO: 10019 - protein, 14 aa, Mus sp.
GKKFTAPHILIATG

SEQ ID NO: 10020 - protein, 17 aa, Mus sp.
YVELPPSVSQAATSPPG

SEQ ID NO: 10021 - protein, 18 aa, Mus sp.
AARDNMFSGSKINYTENR

SEQ ID NO: 10022 - protein, 16 aa, Mus sp.
YNPEAMVAPSVLSNIQ

SEQ ID NO: 10023 - protein, 17 aa, Mus sp.
LQKTQYISPNLNPNDVT

SEQ ID NO: 10024 - protein, 15 aa, Mus sp.
DQKFYNFVVIHARAD

SEQ ID NO: 10025 - protein, 16 aa, Mus sp.
FKKWVNTPFTASSIEL

SEQ ID NO: 10026 - protein, 15 aa, Mus sp.
LPTYDASKVTASGPG

SEQ ID NO: 10027 - protein, 14 aa, Mus sp.
VPIYEGYALPHAIL

SEQ ID NO: 10028 - protein, 16 aa, Mus sp.
TPAPTPAATPAASPAP

SEQ ID NO: 10029 - protein, 15 aa, Mus sp.
YPNSFSAPEQQRSAL

SEQ ID NO: 10030 - protein, 14 aa, Mus sp.
IDWTYRPPSSSRTE

SEQ ID NO: 10031 - protein, 13 aa, Mus sp.
EVQWQSAEPGSTP

SEQ ID NO: 10032 - protein, 16 aa, Mus sp.
NNQAYHSPATALAIVD

SEQ ID NO: 10033 - protein, 15 aa, Mus sp.
YTWSSRGPSADGALG

SEQ ID NO: 10034 - protein, 15 aa, Mus sp.
MPDMHFKAPKISMPD

SEQ ID NO: 10035 - protein, 16 aa, Mus sp.
GALAASAPVVAVAGLG

SEQ ID NO: 10036 - protein, 16 aa, Mus sp.
AEQEVLAPQVVLSLGG

SEQ ID NO: 10037 - protein, 13 aa, Mus sp.
DAEYWNSQPEILE

SEQ ID NO: 10038 - protein, 21 aa, Mus sp.
DDREDITHTYKYPEGSPEERE

SEQ ID NO: 10039 - protein, 21 aa, Mus sp.
FLYQQQGRLDKLTITSQNLQL

SEQ ID NO: 10040 - protein, 16 aa, Mus sp.
FADDYTTANARKLIDE

SEQ ID NO: 10041 - protein, 16 aa, Mus sp.
GGPGSAVSPYPSFNVS

SEQ ID NO: 10042 - protein, 16 aa, Mus sp.
AGEFDYSGSQAIKALK

SEQ ID NO: 10043 - protein, 16 aa, Mus sp.
VFDVTAPNTFKTLDSW

SEQ ID NO: 10044 - protein, 20 aa, Mus sp.
GPEAPLDELVGAYPNYNEEE

SEQ ID NO: 10045 - protein, 15 aa, Mus sp.
LEDFYGSPIPSVSLK

SEQ ID NO: 10046 - protein, 15 aa, Mus sp.
GGKDFNMPLTISSLK

SEQ ID NO: 10047 - protein, 16 aa, Mus sp.
ISKQEYDESGPSIVHR

SEQ ID NO: 10048 - protein, 15 aa, Mus sp.
KPVPAAPVPSPVAPA

SEQ ID NO: 10049 - protein, 18 aa, Mus sp.
APISSHTAPRPNPTPALP

SEQ ID NO: 10050 - protein, 14 aa, Mus sp.
EDVTFIGPDTHAIQ

SEQ ID NO: 10051 - protein, 19 aa, Mus sp.
DPAGPNFEYAEAPSRLSPD

SEQ ID NO: 10052 - protein, 15 aa, Mus sp.
GQNAWFLPAQADIVA

SEQ ID NO: 10053 - protein, 19 aa, Mus sp.
VPEESSSFEGAQVEHSTSR

SEQ ID NO: 10054 - protein, 13 aa, Mus sp.
AEQEVLAPQVVLS

SEQ ID NO: 10055 - protein, 23 aa, Mus sp.
DEDLETKKFRFEEPVVLPDLSDQ

SEQ ID NO: 10056 - protein, 17 aa, Mus sp.
GSVHTYVGGLPEVSVIS

SEQ ID NO: 10057 - protein, 15 aa, Mus sp.
SVAFIKPGVNKAEVT

SEQ ID NO: 10058 - protein, 19 aa, Mus sp.
NPTDAYLDAMMNEAPGPIN

SEQ ID NO: 10059 - protein, 17 aa, Mus sp.
RVKQYYEVPIAMKSVFD

SEQ ID NO: 10060 - protein, 15 aa, Mus sp.
YPTAYPAAAPAYNPS

SEQ ID NO: 10061 - protein, 21 aa, Mus sp.
EDGELTYENVQVSPVPGGPPG

SEQ ID NO: 10062 - protein, 13 aa, Mus sp.
NAANVGWNGSTFA

SEQ ID NO: 10063 - protein, 15 aa, Mus sp.
VGDLYTDPQIHTEKG

SEQ ID NO: 10064 - protein, 15 aa, Mus sp.
TPDYISPEILQAMED

SEQ ID NO: 10065 - protein, 16 aa, Mus sp.
NSEVYHEPHIADAWPQ

SEQ ID NO: 10066 - protein, 24 aa, Mus sp.
EAQKSSSIASFKDPKISTSLPVLD

SEQ ID NO: 10067 - protein, 18 aa, Mus sp.
DLERFLSSAAAVSKEHPV

SEQ ID NO: 10068 - protein, 18 aa, Mus sp.
DKDPFWWNGAEPIWVTNQ

SEQ ID NO: 10069 - protein, 18 aa, Mus sp.
IDTAAKFIGAGAATVGVA

SEQ ID NO: 10070 - protein, 17 aa, Mus sp.
VGGERFEAPEALFQPHL

SEQ ID NO: 10071 - protein, 15 aa, Mus sp.
VPSVIYTHPEVAWVG

SEQ ID NO: 10072 - protein, 19 aa, Mus sp.
NFKKWVNTPFTASSIELVP

SEQ ID NO: 10073 - protein, 23 aa, Mus sp.
LPNKPTVTVVSPLPNDSINPQPS

SEQ ID NO: 10074 - protein, 17 aa, Mus sp.
DPQLSYAVSWAKVSESG

SEQ ID NO: 10075 - protein, 15 aa, Mus sp.
APAAAEAPAAAEAPA

SEQ ID NO: 10076 - protein, 12 aa, Mus sp.
FGPYYTEPVIAG

SEQ ID NO: 10077 - protein, 17 aa, Mus sp.
SHPQYAEPGAEAAFSGR

SEQ ID NO: 10078 - protein, 16 aa, Mus sp.
EMYKVHNPVPLIVGSS

SEQ ID NO: 10079 - protein, 14 aa, Mus sp.
YAVDIRSPAISWVN

SEQ ID NO: 10080 - protein, 13 aa, Mus sp.
EVSSVEAPSVSPA

SEQ ID NO: 10081 - protein, 22 aa, Mus sp.
QPVRKNKMASNIFGTPEENPPS

SEQ ID NO: 10082 - protein, 23 aa, Listeria monocytogenes
RYVFDTAKATAASSYPGSDETPP

SEQ ID NO: 10083 - protein, 14 aa, Mus sp.
LLYNVPAVAEEIQD

SEQ ID NO: 10084 - protein, 28 aa, Mus sp.
NVDPFKAVDTNRASMGQASPESKGFTDL

SEQ ID NO: 10085 - protein, 25 aa, Mus sp.
IPELNGKLTGMAFRVPTPNVSVVDL

SEQ ID NO: 10086 - protein, 17 aa, Mus sp.
YPTPAYTIPFYTPIPNG

SEQ ID NO: 10087 - protein, 17 aa, Mus sp.
PTLDHYKEPSAIFQLPY

SEQ ID NO: 10088 - protein, 15 aa, Mus sp.
SLQAFSNPSAGISVD

SEQ ID NO: 10089 - protein, 16 aa, Mus sp.
IMLLYNGPKVNLVIIK

SEQ ID NO: 10090 - protein, 16 aa, Mus sp.
KLQEFELPYVSVTSLR

SEQ ID NO: 10091 - protein, 19 aa, Mus sp.
SPPPGGYGQPSVLPGGYPA

SEQ ID NO: 10092 - protein, 23 aa, Mus sp.
TPSPESPDQWSSSSPHSASDWSD

SEQ ID NO: 10093 - protein, 17 aa, Mus sp.
APPAGSLYSSPVNSSAP

SEQ ID NO: 10094 - protein, 16 aa, BOVIN
SVVVGPSVVAVPLPLH

SEQ ID NO: 10095 - protein, 16 aa, Mus sp.
SMPDYKPSFPKWARQD

SEQ ID NO: 10096 - protein, 15 aa, Mus sp.
LSYREPDPEDAVGGS

SEQ ID NO: 10097 - protein, 15 aa, Mus sp.
VPATFAPSPTPAVVS

SEQ ID NO: 10098 - protein, 24 aa, Mus sp.
LDSLIGDSNFGAPSASVAAAPAPA

SEQ ID NO: 10099 - protein, 16 aa, Mus sp.
NPLNSVFVAPAVTPVK

SEQ ID NO: 10100 - protein, 21 aa, Mus sp.
YPPPYPPAAFQGPSDHAAYPI

SEQ ID NO: 10101 - protein, 16 aa, Mus sp.
NPPSYYTQPVPVPNAN

SEQ ID NO: 10102 - protein, 15 aa, Mus sp.
KNNSFYGPEVKIEKG

SEQ ID NO: 10103 - protein, 18 aa, Mus sp.
VHKAFVEVNEEGTEAAAA

SEQ ID NO: 10104 - protein, 15 aa, Mus sp.
AEEYLGMPVANAVIS

SEQ ID NO: 10105 - protein, 19 aa, Mus sp.
DGELTYENVQVSPVPGGPP

SEQ ID NO: 10106 - protein, 16 aa, Mus sp.
APLDELVGAYPNYNEE

SEQ ID NO: 10107 - protein, 15 aa, Mus sp.
VSSYTPPQPSYSQPP

SEQ ID NO: 10108 - protein, 16 aa, Mus sp.
GEPYMYLSPLQQAVSD

SEQ ID NO: 10109 - protein, 17 aa, Mus sp.
SPTSPSYSPTSPSYSPT

SEQ ID NO: 10110 - protein, 18 aa, Mus sp.
VQIPKVVKSPSSLPAKPL

SEQ ID NO: 10111 - protein, 16 aa, Mus sp.
RITPSYVAFTPEGERL

SEQ ID NO: 10112 - protein, 13 aa, Mus sp.
ETFNTPAMYVAIQ

SEQ ID NO: 10113 - protein, 14 aa, Mus sp.
VDEYDYSKPIQGQQ

SEQ ID NO: 10114 - protein, 17 aa, Mus sp.
ERFGVRFPAMSDAYDRD

SEQ ID NO: 10115 - protein, 25 aa, Mus sp.
LPDGRIIKVGGERFEAPEALFQPHL

SEQ ID NO: 10116 - protein, 11 aa, Mus sp.
HDLDFRAPHVL

SEQ ID NO: 10117 - protein, 17 aa, Mus sp.
GDSVVFAGPAGNSVETR

SEQ ID NO: 10118 - protein, 19 aa, Mus sp.
VVHKAFVEVNEEGTEAAAA

SEQ ID NO: 10119 - protein, 18 aa, Mus sp.
VPYVEKYRPASASVSALI

SEQ ID NO: 10120 - protein, 15 aa, Mus sp.
LPNSFDGPVTITIVN

SEQ ID NO: 10121 - protein, 18 aa, Mus sp.
MRTSVDQNVYPSQNGTPN

SEQ ID NO: 10122 - protein, 12 aa, Mus sp.
RDYVPPTANLDQ

SEQ ID NO: 10123 - protein, 18 aa, Mus sp.
FAAEEFKVPAATSAIITN

SEQ ID NO: 10124 - protein, 17 aa, Mus sp.
NSNKQYLFPETLVIGEK

SEQ ID NO: 10125 - protein, 19 aa, Mus sp.
APISSHTAPRPNPTPALPQ

SEQ ID NO: 10126 - protein, 14 aa, Mus sp.
HPIQWNAPEPSHIT

SEQ ID NO: 10127 - protein, 18 aa, Mus sp.
DPKLTYHGFTLEDAASPK

SEQ ID NO: 10128 - protein, 16 aa, Listeria monocytogenes
KEKVVATPVSNVSTSS

SEQ ID NO: 10129 - protein, 15 aa, Mus sp.
EIQDWSASSPHSAAY

SEQ ID NO: 10130 - protein, 17 aa, Listeria monocytogenes
TTVKFTLPTVAPAFENT

SEQ ID NO: 10131 - protein, 15 aa, Mus sp.
LPTTFQGATASTSYG

SEQ ID NO: 10132 - protein, 13 aa, Mus sp.
NSVFVAPAVTPVK

SEQ ID NO: 10133 - protein, 33 aa, Mus sp.; identical to SEQ ID NO: 2080

SEQ ID NO: 10134 - protein, 21 aa, Listeria monocytogenes
STVVVEAGDTLWGIAQSKGTT

SEQ ID NO: 10135 - protein, 16 aa, Mus sp.
KPSGYNPPISILGILE

SEQ ID NO: 10136 - protein, 14 aa, Mus sp.
EDYVELPPSVSQAA

SEQ ID NO: 10137 - protein, 16 aa, Mus sp.
FLKKWETPSQNTAQLD

SEQ ID NO: 10138 - protein, 13 aa, Mus sp.
SFKDPKISTSLPV

SEQ ID NO: 10139 - protein, 18 aa, Mus sp.
IKPGTTVEYLAPWANQID

SEQ ID NO: 10140 - protein, 13 aa, Mus sp.
GDSERHFVYQFMG

SEQ ID NO: 10141 - protein, 19 aa, Mus sp.
IPSPSSAFTPAHAATSSHA

SEQ ID NO: 10142 - protein, 15 aa, Mus sp.
STPSYSIPEASFQDS

SEQ ID NO: 10143 - protein, 16 aa, Mus sp.
FGPYYTEPVIAGLDPK

SEQ ID NO: 10144 - protein, 12 aa, Mus sp.
EFDYSGSQAIKA

SEQ ID NO: 10145 - protein, 11 aa, Mus sp.
DYVPPTANLDQ

SEQ ID NO: 10146 - protein, 19 aa, Mus sp.
FEDYVELPPSVSQAAKSPP

SEQ ID NO: 10147 - protein, 13 aa, Mus sp.
LEPYLEPRSPEAR

SEQ ID NO: 10148 - protein, 14 aa, BOVIN
SVVVGPSVVAVPLP

SEQ ID NO: 10149 - protein, 16 aa, Mus sp.
DVPEWFRGSRLNYAEN

SEQ ID NO: 10150 - protein, 15 aa, Mus sp.
EDYVQSMDVAAFNKI

SEQ ID NO: 10151 - protein, 19 aa, Mus sp.
GKLTGMAFRVPTPNVSVVD

SEQ ID NO: 10152 - protein, 14 aa, Mus sp.
GGDPFAAPQVVPAF

SEQ ID NO: 10153 - protein, 14 aa, Mus sp.
FTYQQPQPLSVEPR

SEQ ID NO: 10154 - protein, 15 aa, Mus sp.
FPYEGPAPLEAIANG

SEQ ID NO: 10155 - protein, 15 aa, Mus sp.
LRDMYSKSSAAMSTY

SEQ ID NO: 10156 - protein, 26 aa, Mus sp.
VEWTNNGKTELNYKNTEPVLDSDGSY

SEQ ID NO: 10157 - protein, 17 aa, Mus sp.
VPYPRIHFPLATYAPVI

SEQ ID NO: 10158 - protein, 14 aa, Mus sp.
YYLPYKSPGINVDS

SEQ ID NO: 10159 - protein, 14 aa, Mus sp.
DHPGNYVEPTIVTG

SEQ ID NO: 10160 - protein, 17 aa, Mus sp.
EPPQYPYIPAHITKPKE

SEQ ID NO: 10161 - protein, 17 aa, Mus sp.
KKELEEQLGPVAEETRA

SEQ ID NO: 10162 - protein, 15 aa, Mus sp.
EWKFTITPPSAQVVG

SEQ ID NO: 10163 - protein, 16 aa, Mus sp.
EPYEVHNPVPLIVGSS

SEQ ID NO: 10164 - protein, 14 aa, Mus sp.
QDAYHFFSPEPLNS

SEQ ID NO: 10165 - protein, 17 aa, Mus sp.
VEPGNFIAATSLYSPER

SEQ ID NO: 10166 - protein, 20 aa, Mus sp.
QPTGPPPYHESLAGASQPPY

SEQ ID NO: 10167 - protein, 15 aa, Mus sp.
KWKALYTDPKSSETA

SEQ ID NO: 10168 - protein, 20 aa, Mus sp.
DPAGPNFEYAEAPSRLSPDD

SEQ ID NO: 10169 - protein, 23 aa, Mus sp.
LMEKIQASVATNPIITPVAQENQ

SEQ ID NO: 10170 - protein, 15 aa, Mus sp.
ESKATYSTNSPVWEE

SEQ ID NO: 10171 - protein, 20 aa, Listeria monocytogenes
VDDTTVKFTLPTVAPAFENT

SEQ ID NO: 10172 - protein, 20 aa, Mus sp.
TPPSPKVTYKAPVPTGEVYF

SEQ ID NO: 10173 - protein, 15 aa, Mus sp.
SIVYWMTSQPSDAVR

SEQ ID NO: 10174 - protein, 20 aa, Mus sp.
DLDEQEFVYKEPAITKLPEI

SEQ ID NO: 10175 - protein, 13 aa, Mus sp.
VNWYAPLVAPISK

SEQ ID NO: 10176 - protein, 17 aa, Mus sp.
SADDFFQGTKAALAGGT

SEQ ID NO: 10177 - protein, 15 aa, Mus sp.
QYPNFAGPQAALANK

SEQ ID NO: 10178 - protein, 13 aa, BOVIN
SVVVGPSVVAVPL

SEQ ID NO: 10179 - protein, 20 aa, Mus sp.
FEDYVELPPSVSQAATSPPG

SEQ ID NO: 10180 - protein, 21 aa, Mus sp.
GTPEYIAPEVIFRQGYGKPVD

SEQ ID NO: 10181 - protein, 15 aa, Mus sp.
TPYYVAPEVLGPEKY

SEQ ID NO: 10182 - protein, 15 aa, Mus sp.
AEEYEFLTPMEEAPK

SEQ ID NO: 10183 - protein, 17 aa, Mus sp.
GTPDYISPEVLKSQGGD

SEQ ID NO: 10184 - protein, 14 aa, Mus sp.
MAPYQGPDAAPGAL

SEQ ID NO: 10185 - protein, 16 aa, Listeria monocytogenes
EVEDLNQPLAAHVNYE

SEQ ID NO: 10186 - protein, 15 aa, Mus sp.
VEALEQPAPAIVSAL

SEQ ID NO: 10187 - protein, 15 aa, Mus sp.
TALTFSSPATNQAIT

SEQ ID NO: 10188 - protein, 17 aa, Mus sp.
DLGSDIFAAPAPQSTAT

SEQ ID NO: 10189 - protein, 16 aa, Mus sp.
NLPENFRRPQTDQAVE

SEQ ID NO: 10190 - protein, 15 aa, Mus sp.
RPHWLEPTIYSSEED

SEQ ID NO: 10191 - protein, 27 aa, Mus sp.
GDQGRDGIPGPPGEKGETGLLGAYPGP

SEQ ID NO: 10192 - protein, 16 aa, Mus sp.
EEWGPFKAPHANRFIF

SEQ ID NO: 10193 - protein, 17 aa, Mus sp.
EDWPTFLNPNVDKAGPA

SEQ ID NO: 10194 - protein, 15 aa, Mus sp.
FPIKWTAPEAALYGR

SEQ ID NO: 10195 - protein, 15 aa, Mus sp.
EDYVELPPSVSQAAT

SEQ ID NO: 10196 - protein, 14 aa, Mus sp.
REVSSVEAPSVSPA

SEQ ID NO: 10197 - protein, 18 aa, Mus sp.
QPSTSSLAAPTVEAAASA

SEQ ID NO: 10198 - protein, 11 aa, Mus sp.
DYFKGAIPIRK

SEQ ID NO: 10199 - protein, 15 aa, Mus sp.
TIQWWNMPSPNVDPY

SEQ ID NO: 10200 - protein, 17 aa, Mus sp.
SLHLRFSAPQIENEPET

SEQ ID NO: 10201 - protein, 19 aa, Mus sp.
LPPASLPESTPVPSSSPPP

SEQ ID NO: 10202 - protein, 16 aa, Mus sp.
GPVPEFSGATVERVSE

SEQ ID NO: 10203 - protein, 12 aa, Mus sp.
DYVATSIHEAVT

SEQ ID NO: 10204 - protein, 17 aa, Mus sp.
SARTVITPDPNLSIDQV

SEQ ID NO: 10205 - protein, 15 aa, Mus sp.
INPDNVATPIAASLG

SEQ ID NO: 10206 - protein, 21 aa, Mus sp.
EPSPVSETVVTPEAAPEKNPV

SEQ ID NO: 10207 - protein, 26 aa, Mus sp.
VDPTPDPNTAYASYPSASVENYQQPP

SEQ ID NO: 10208 - protein, 21 aa, Mus sp.
EDPNYSPQRFPNAHRAFADDP

SEQ ID NO: 10209 - protein, 15 aa, Mus sp.
YPFDFQGAKIITGQE

SEQ ID NO: 10210 - protein, 15 aa, Mus sp.
EVQWQSAEPGSTPRK

SEQ ID NO: 10211 - protein, 21 aa, Mus sp.
EKPVPAAPVPSPVAPAPVPSR

SEQ ID NO: 10212 - protein, 15 aa, Mus sp.
MYPTGAPGAQAAPQA

SEQ ID NO: 10213 - protein, 19 aa, Mus sp.
VPDVDISSPGINVEAPDIH

SEQ ID NO: 10214 - protein, 13 aa, Mus sp.
LDEFYSDPHAVAG

SEQ ID NO: 10215 - protein, 17 aa, Mus sp.
EEVNIKTAEAQLAYELQ

SEQ ID NO: 10216 - protein, 17 aa, Mus sp.
GNNCKNGGACVDGVNTY

SEQ ID NO: 10217 - protein, 16 aa, Mus sp.
LPNSFDGPVTITIVNR

SEQ ID NO: 10218 - protein, 16 aa, Mus sp.
LSLKYHFVTPLTSMVV

SEQ ID NO: 10219 - protein, 16 aa, Mus sp.
INKMDDPTVNWSNERY

SEQ ID NO: 10220 - protein, 20 aa, Mus sp.
TPSAAYLWVGAGASEAEKTG

SEQ ID NO: 10221 - protein, 15 aa, Mus sp.
ETVVTPEAAPEKNPV

SEQ ID NO: 10222 - protein, 13 aa, Mus sp.
SALEYGMPVTLIG

SEQ ID NO: 10223 - protein, 17 aa, Mus sp.
VLVFDVTAPNTFKTLDS

SEQ ID NO: 10224 - protein, 20 aa, Mus sp.
KLTGMAFRVPTPNVSVVDLT

SEQ ID NO: 10225 - protein, 14 aa, Mus sp.
TAPEYYAPEVHQHD

SEQ ID NO: 10226 - protein, 15 aa, Mus sp.
LDDFEAGTATAAPPG

SEQ ID NO: 10227 - protein, 13 aa, Mus sp.
GTPEYLAPEIILS

SEQ ID NO: 10228 - protein, 13 aa, Mus sp.
DIYVWRGAQATLS

SEQ ID NO: 10229 - protein, 18 aa, Mus sp.
IEVDQIYHLASPASPPNY

SEQ ID NO: 10230 - protein, 18 aa, Mus sp.
APAPEFTAAQPEVADWSE

SEQ ID NO: 10231 - protein, 13 aa, Mus sp.
NDLQYAAPGGLIG

SEQ ID NO: 10232 - protein, 15 aa, Mus sp.
LPENFRRPQTDQAVE

SEQ ID NO: 10233 - protein, 16 aa, Mus sp.
LPYVQYFGGVSALSKQ

SEQ ID NO: 10234 - protein, 17 aa, Mus sp.
LSRWEQEQIRKGINIPQ

SEQ ID NO: 10235 - protein, 24 aa, Mus sp.
GPPGFEDYVELPPSVSQAAKSPPG

SEQ ID NO: 10236 - protein, 16 aa, Mus sp.
MRPFYQGPVGDPATYR

SEQ ID NO: 10237 - protein, 14 aa, Mus sp.
LPAAAQAPDALPAG

SEQ ID NO: 10238 - protein, 16 aa, Mus sp.
WKFTITPPSAQVVGVL

SEQ ID NO: 10239 - protein, 15 aa, Mus sp.
DTAAKFIGAGAATVG

SEQ ID NO: 10240 - protein, 17 aa, Mus sp.
ETDSVVSSVTTKAKGVA

SEQ ID NO: 10241 - protein, 17 aa, Mus sp.
QPGLNGAAAAAAAEAPD

SEQ ID NO: 10242 - protein, 17 aa, Mus sp.
APAPAAAPAAAPAAAPE

SEQ ID NO: 10243 - protein, 19 aa, Mus sp.
KIPEVDMARVVAPFMSNIP

SEQ ID NO: 10244 - protein, 14 aa, Mus sp.
QKQQWITPFTNGDK

SEQ ID NO: 10245 - protein, 11 aa, Mus sp.
TIPFYTPIPNG

SEQ ID NO: 10246 - protein, 17 aa, Mus sp.
IPETYPFNPPKVRFITK

SEQ ID NO: 10247 - protein, 17 aa, Mus sp.
DDDVYRAPPIDRSILPT

SEQ ID NO: 10248 - protein, 16 aa, Mus sp.
HNTEFKDSTYDLPRSL

SEQ ID NO: 10249 - protein, 16 aa, Mus sp.
YLPETFRRPQIDPAVE

SEQ ID NO: 10250 - protein, 15 aa, Mus sp.
APHVAYMQPKANAPS

SEQ ID NO: 10251 - protein, 15 aa, Mus sp.
NDLQYAAPGGLIGVG

SEQ ID NO: 10252 - protein, 16 aa, Mus sp.
LPANAFASPLQNPDNH

SEQ ID NO: 10253 - protein, 23 aa, Mus sp.
TPARAPETRSQVTPSVPSEALDD

SEQ ID NO: 10254 - protein, 16 aa, Mus sp.
GPASEWTFSTPEGVPG

SEQ ID NO: 10255 - protein, 17 aa, Mus sp.
TPDPNTAYASYPSASVE

SEQ ID NO: 10256 - protein, 16 aa, Mus sp.
ESKEAFQEALAAAGDK

SEQ ID NO: 10257 - protein, 17 aa, Mus sp.
VHLWRYEGGYPALTEVM

SEQ ID NO: 10258 - protein, 18 aa, Mus sp.
LVTEDNVFEAPTLVKVFK

SEQ ID NO: 10259 - protein, 13 aa, Mus sp.
ITDKFWGPSGAES

SEQ ID NO: 10260 - protein, 17 aa, Mus sp.
GGYKPFQNPVPNQSPSS

SEQ ID NO: 10261 - protein, 17 aa, Mus sp.
SPDDPSRYITPDQLADL

SEQ ID NO: 10262 - protein, 11 aa, Mus sp.
LSYIGPSVNKA

SEQ ID NO: 10263 - protein, 17 aa, Mus sp.
EPYLEPRSPEARGVEAP

SEQ ID NO: 10264 - protein, 17 aa, Mus sp.
SPHPYQLPQALAPHVDF

SEQ ID NO: 10265 - protein, 14 aa, Mus sp.
MRYFETAVSRPGLE

SEQ ID NO: 10266 - protein, 14 aa, Mus sp.
LGEFDTPEAIWSSE

SEQ ID NO: 10267 - protein, 17 aa, Mus sp.
VQIPKVVKSPSSLPAKP

SEQ ID NO: 10268 - protein, 19 aa, BOVIN
APSAVPDAAGPTPSAAGPP

SEQ ID NO: 10269 - protein, 11 aa, Mus sp.
LPYDTPVPGYM

SEQ ID NO: 10270 - protein, 16 aa, Mus sp.
KPVPAAPVPSPVAPAP

SEQ ID NO: 10271 - protein, 14 aa, Mus sp.
ALDTFNTSLVTPIY

SEQ ID NO: 10272 - protein, 18 aa, Mus sp.
EDITHTYKYPEGSPEERE

SEQ ID NO: 10273 - protein, 13 aa, Mus sp.
FDIFYTAPQPGKY

SEQ ID NO: 10274 - protein, 18 aa, Mus sp.
NGNPLNSVFVAPAVTPVK

SEQ ID NO: 10275 - protein, 16 aa, Mus sp.
LPQDPTFHTPLDLYAY

SEQ ID NO: 10276 - protein, 16 aa, Mus sp.
WQKIQEPYTFPAILKS

SEQ ID NO: 10277 - protein, 22 aa, Mus sp.
IQEMEKEDRRYNPPIIHQGFQD

SEQ ID NO: 10278 - protein, 13 aa, Mus sp.
KTQYISPNLNPND

SEQ ID NO: 10279 - protein, 17 aa, Mus sp.
EYQQYQDATAEEEEDFG

SEQ ID NO: 10280 - protein, 16 aa, Mus sp.
AAATTAAPAAAAAPAK

SEQ ID NO: 10281 - protein, 15 aa, Mus sp.
LPQDPTFHTPLDLYA

SEQ ID NO: 10282 - protein, 17 aa, Mus sp.
LVKDGYQMAQPVFAPKN

SEQ ID NO: 10283 - protein, 16 aa, Mus sp.
DSENMEREAETVDLDD

SEQ ID NO: 10284 - protein, 11 aa, Mus sp.
PIITPVAQENQ

SEQ ID NO: 10285 - protein, 15 aa, Mus sp.
GAPFDWEGAQASQAL

SEQ ID NO: 10286 - protein, 18 aa, Mus sp.
NRDGDSYRSPWSNKYDPP

SEQ ID NO: 10287 - protein, 14 aa, Mus sp.
EDNWSLPNRAVEPQ

SEQ ID NO: 10288 - protein, 13 aa, Mus sp.
TPEYLAPEVLEDN

SEQ ID NO: 10289 - protein, 17 aa, Mus sp.
KKWVNTPFTASSIELVP

SEQ ID NO: 10290 - protein, 13 aa, Mus sp.
EQIAVVAPEPLLT

SEQ ID NO: 10291 - protein, 17 aa, Mus sp.
VPTDKYYGAQTVRSTMN

SEQ ID NO: 10292 - protein, 16 aa, Mus sp.
SSPEFKGSQASLSDSL

SEQ ID NO: 10293 - protein, 16 aa, Mus sp.
SPKVTYKAPVPTGEVY

SEQ ID NO: 10294 - protein, 15 aa, Mus sp.
EDTVTISGPQAAVNE

SEQ ID NO: 10295 - protein, 16 aa, Mus sp.
AAEEFKVPAATSAIIT

SEQ ID NO: 10296 - protein, 15 aa, Mus sp.
YQMYGGPVVLVAHSM

SEQ ID NO: 10297 - protein, 12 aa, Mus sp.
VEPYEVHNPVPL

SEQ ID NO: 10298 - protein, 13 aa, Mus sp.
VTYEWAPPVQNQA

SEQ ID NO: 10299 - protein, 13 aa, Mus sp.
IDPYDQPNAIYIE

SEQ ID NO: 10300 - protein, 16 aa, Mus sp.
FPPEFYEHAKALWEDE

SEQ ID NO: 10301 - protein, 19 aa, Mus sp.
APLNVQFSSPLPGEAVKDL

SEQ ID NO: 10302 - protein, 14 aa, Mus sp.
ANPDFTQPISEVVD

SEQ ID NO: 10303 - protein, 21 aa, Mus sp.
IKVPDVDISSPGINVEAPDIH

SEQ ID NO: 10304 - protein, 17 aa, Mus sp.
EVNSQYQEPDIIIHFAR

SEQ ID NO: 10305 - protein, 17 aa, Mus sp.
KGADKTVKGPDGLTALE

SEQ ID NO: 10306 - protein, 14 aa, Mus sp.
NVNIFKFIIPNIVK

SEQ ID NO: 10307 - protein, 30 aa, Mus sp.; identical to SEQ ID NO: 1359

SEQ ID NO: 10308 - protein, 15 aa, Mus sp.
LRIINEPTAAAIAYG

SEQ ID NO: 10309 - protein, 16 aa, Mus sp.
VQAFTHAPAALEADRG

SEQ ID NO: 10310 - protein, 24 aa, Mus sp.
IQEMEKEDRRYNPPIIHQGFQDTS

SEQ ID NO: 10311 - protein, 14 aa, Mus sp.
APYQGPDAAPGALD

SEQ ID NO: 10312 - protein, 16 aa, Mus sp.
EDLNYHDPTVKHSTFH

SEQ ID NO: 10313 - protein, 15 aa, Mus sp.
GALLLNAPVVSITQG

SEQ ID NO: 10314 - protein, 16 aa, Mus sp.
GNSEFDPPGPNVATTT

SEQ ID NO: 10315 - protein, 13 aa, Mus sp.
QLIRNGDWTFQVL

SEQ ID NO: 10316 - protein, 12 aa, Mus sp.
EQEVLAPQVVLS

SEQ ID NO: 10317 - protein, 15 aa, Mus sp.
APAPEFTAAQPEVAD

SEQ ID NO: 10318 - protein, 13 aa, Mus sp.
RYNPPIIHQGFQD

SEQ ID NO: 10319 - protein, 16 aa, Mus sp.
IFGTHHNPAVWPDPEV

SEQ ID NO: 10320 - protein, 15 aa, Mus sp.
AGMAVFTPVINGVGG

SEQ ID NO: 10321 - protein, 15 aa, Mus sp.
KFVYAGSNSGVVQAP

SEQ ID NO: 10322 - protein, 15 aa, Mus sp.
DFLKKWETPSQNTAQ

SEQ ID NO: 10323 - protein, 19 aa, Mus sp.
GEQIYYAGPVNNPGLDVPQ

SEQ ID NO: 10324 - protein, 20 aa, Mus sp.
QPSTSSLAAPTVEAAASAPA

SEQ ID NO: 10325 - protein, 21 aa, Mus sp.
APSEERVYMVGKANSVFEDLS

SEQ ID NO: 10326 - protein, 14 aa, Mus sp.
TGVDFIGSTVGLAK

SEQ ID NO: 10327 - protein, 12 aa, Mus sp.
APDTRFVAPGAL

SEQ ID NO: 10328 - protein, 21 aa, Mus sp.
ITFPLKQQRHTAAPTDPTDGP

SEQ ID NO: 10329 - protein, 19 aa, Mus sp.
LITGVDFIGSTVGLAKVSA

SEQ ID NO: 10330 - protein, 16 aa, Mus sp.
IRSDWTNPEINKAVLH

SEQ ID NO: 10331 - protein, 17 aa, Mus sp.
DDLPTTFQGATASTSYG

SEQ ID NO: 10332 - protein, 15 aa, Mus sp.
TPYSTPQMSPATTPA

SEQ ID NO: 10333 - protein, 18 aa, Mus sp.
TALTFSSPATNQAITIPV

SEQ ID NO: 10334 - protein, 15 aa, Mus sp.
NLDWQYPGSRGSPPK

SEQ ID NO: 10335 - protein, 11 aa, Mus sp.
SDWTNPEINKA

SEQ ID NO: 10336 - protein, 13 aa, Mus sp.
TPEYLAPEIILSK

SEQ ID NO: 10337 - protein, 14 aa, Mus sp.
ADDIVGPVTHEIFE

SEQ ID NO: 10338 - protein, 16 aa, Mus sp.
DELSKTISPMVMDAKA

SEQ ID NO: 10339 - protein, 18 aa, Mus sp.
GPASEWTFSTPEGVPGHP

SEQ ID NO: 10340 - protein, 16 aa, Mus sp.
LSIQWESSRPLLASIE

SEQ ID NO: 10341 - protein, 16 aa, Mus sp.
ADKTVKGPDGLTALEA

SEQ ID NO: 10342 - protein, 16 aa, Mus sp.
VGGERFEAPEALFQPH

SEQ ID NO: 10343 - protein, 14 aa, Mus sp.
GTPDYIAPEIIAYQ

SEQ ID NO: 10344 - protein, 14 aa, Mus sp.
FPYEGPAPLEAIAN

SEQ ID NO: 10345 - protein, 17 aa, Mus sp.
IWRDYVPPTANLDQKDK

SEQ ID NO: 10346 - protein, 21 aa, Listeria monocytogenes
AVDDTTVKFTLPTVAPAFENT

SEQ ID NO: 10347 - protein, 20 aa, Mus sp.
DEGERYIAPTVLVDVQETEP

SEQ ID NO: 10348 - protein, 14 aa, Mus sp.
ISNYGFPRSVQAID

SEQ ID NO: 10349 - protein, 20 aa, Mus sp.
GVPVPGSPFPLEAVAPTKPS

SEQ ID NO: 10350 - protein, 17 aa, Mus sp.
IAGVVYKDGIVLGADTR

SEQ ID NO: 10351 - protein, 14 aa, Mus sp.
SNPSYNYEIVNRAS

SEQ ID NO: 10352 - protein, 23 aa, Mus sp.
PGPNIGGDTHFDSAEPWTVQNED

SEQ ID NO: 10353 - protein, 20 aa, Mus sp.
DLYTAKGLFRAAVPSGASTG

SEQ ID NO: 10354 - protein, 17 aa, Mus sp.
KELSFAPPMSDRSGDGI

SEQ ID NO: 10355 - protein, 19 aa, Mus sp.
ETKKFRFEEPVVLPDLSDQ

SEQ ID NO: 10356 - protein, 19 aa, Mus sp.
EQPGLNGAAAAAAAEAPDE

SEQ ID NO: 10357 - protein, 17 aa, Mus sp.
FGKWKYEKPDGSPVFIA

SEQ ID NO: 10358 - protein, 16 aa, Mus sp.
WKALYTDPKSSETAAF

SEQ ID NO: 10359 - protein, 17 aa, Mus sp.
VFDVTAPNTFKTLDSWR

SEQ ID NO: 10360 - protein, 17 aa, Mus sp.
DVVDRVLKSPVASIVYE

SEQ ID NO: 10361 - protein, 22 aa, Mus sp.
RPDAEYWNSQPEILERTRAELD

SEQ ID NO: 10362 - protein, 20 aa, Mus sp.
SSSIASFKDPKISTSLPVLD

SEQ ID NO: 10363 - protein, 20 aa, Mus sp.
FPKPPSYNVATTLPSYDEAE

SEQ ID NO: 10364 - protein, 17 aa, Mus sp.
YPNSFSAPEQQRSALEH

SEQ ID NO: 10365 - protein, 17 aa, Mus sp.
HKLSYLTFIPSDDDIYD

SEQ ID NO: 10366 - protein, 14 aa, Mus sp.
FTITPPSAQVVGVL

SEQ ID NO: 10367 - protein, 26 aa, Mus sp.
LPNKPTVTVVSPLPNDSINPQPSPDG

SEQ ID NO: 10368 - protein, 19 aa, Mus sp.
GVEAARDNMFSGSKINYTE

SEQ ID NO: 10369 - protein, 26 aa, Mus sp.
YPPPPQSDSASSPSPSFSEDNLPPPP

SEQ ID NO: 10370 - protein, 17 aa, Mus sp.
LEFIDVHVKLPRFKIEE

SEQ ID NO: 10371 - protein, 15 aa, Mus sp.
FATGFSHPLTQSAVM

SEQ ID NO: 10372 - protein, 22 aa, Mus sp.
GPNIGGDTHFDSAEPWTVQNED

SEQ ID NO: 10373 - protein, 19 aa, Mus sp.
QPPPAYEPPAPAPAPLPPP

SEQ ID NO: 10374 - protein, 17 aa, Mus sp.
NKPEDYQGGRTGEAIVD

SEQ ID NO: 10375 - protein, 19 aa, Mus sp.
AGEFDYSGSQAIKALKEEN

SEQ ID NO: 10376 - protein, 13 aa, Mus sp.
IQEPYTFPAILKS

SEQ ID NO: 10377 - protein, 18 aa, Mus sp.
TPIPQSGSPFPASVQDPG

SEQ ID NO: 10378 - protein, 17 aa, Mus sp.
GIPVYRFVLPANAFASP

SEQ ID NO: 10379 - protein, 15 aa, Mus sp.
DLDIFNLPNVEISKD

SEQ ID NO: 10380 - protein, 15 aa, Mus sp.
LVKDGYQMAQPVFAP

SEQ ID NO: 10381 - protein, 15 aa, Mus sp.
IKIAWESPQGQVSRY

SEQ ID NO: 10382 - protein, 18 aa, Mus sp.
EPTSSSPYNPPDLEEAAK

SEQ ID NO: 10383 - protein, 14 aa, Mus sp.
YPNSFSAPEQQRSA

SEQ ID NO: 10384 - protein, 15 aa, Mus sp.
RDYVPPTANLDQKDK

SEQ ID NO: 10385 - protein, 18 aa, Mus sp.
GTVIHFNNPKVQASLAAN

SEQ ID NO: 10386 - protein, 17 aa, Mus sp.
MPDMHFKTPKISMPDID

SEQ ID NO: 10387 - protein, 12 aa, Mus sp.
EEYSAPLPTPAP

SEQ ID NO: 10388 - protein, 17 aa, Mus sp.
KPNGIFKGPTAENAEYL

SEQ ID NO: 10389 - protein, 17 aa, Mus sp.
TRSQVTPSVPSEALDDS

SEQ ID NO: 10390 - protein, 14 aa, Mus sp.
GFPYEGPAPLEAIA

SEQ ID NO: 10391 - protein, 13 aa, Mus sp.
RTWNDPSVQQDIK

SEQ ID NO: 10392 - protein, 16 aa, Mus sp.
KEDRRYNPPIIHQGFQ

SEQ ID NO: 10393 - protein, 17 aa, Mus sp.
YTPYYVAPEVLGPEKYD

SEQ ID NO: 10394 - protein, 16 aa, Mus sp.
LSLLYNVPAVAEEIQD

SEQ ID NO: 10395 - protein, 16 aa, Mus sp.
DINAFVGAVSLTAADS

SEQ ID NO: 10396 - protein, 15 aa, Mus sp.
EEVEHWFYPQENIID

SEQ ID NO: 10397 - protein, 16 aa, Mus sp.
TPEYLAPEIILSKGYN

SEQ ID NO: 10398 - protein, 20 aa, Mus sp.
SDDVLANMISEPRISYGNDA

SEQ ID NO: 10399 - protein, 14 aa, Mus sp.
DPYDQPNAIYIERH

SEQ ID NO: 10400 - protein, 15 aa, Mus sp.
KNVTELNEPLSNEER

SEQ ID NO: 10401 - protein, 21 aa, Mus sp.
DPTPDPNTAYASYPSASVENY

SEQ ID NO: 10402 - protein, 17 aa, Mus sp.
EDITHTYKYPEGSPEER

SEQ ID NO: 10403 - protein, 15 aa, Mus sp.
ENDIYNFFSPLNPVR

SEQ ID NO: 10404 - protein, 17 aa, Mus sp.
LPEAPSAESPSPSESPP

SEQ ID NO: 10405 - protein, 14 aa, Mus sp.
LEALVGPEANVGPY

SEQ ID NO: 10406 - protein, 17 aa, Mus sp.
DHDVKIWAPTAEASTEL

SEQ ID NO: 10407 - protein, 19 aa, Mus sp.
GPDGRFVMGPTVAPSQEKL

SEQ ID NO: 10408 - protein, 14 aa, Mus sp.
AGEFDYSGSQAIKA

SEQ ID NO: 10409 - protein, 12 aa, Mus sp.
TSWLDGKHVVFG

SEQ ID NO: 10410 - protein, 11 aa, Mus sp.
QVTQPTVGMNF

SEQ ID NO: 10411 - protein, 20 aa, Mus sp.
APWDPQLSYAVSWAKVSESG

SEQ ID NO: 10412 - protein, 16 aa, Mus sp.
SLEDFYGSPIPSVSLK

SEQ ID NO: 10413 - protein, 15 aa, Mus sp.
LEKAVYQGPGSSPVK

SEQ ID NO: 10414 - protein, 14 aa, Mus sp.
ASFKDPKISTSLPV

SEQ ID NO: 10415 - protein, 19 aa, Mus sp.
KPGTTVEYLAPWANQIDMA

SEQ ID NO: 10416 - protein, 13 aa, Mus sp.
APGGYVAPKAVWL

SEQ ID NO: 10417 - protein, 15 aa, Mus sp.
YIEGYVPSQADVAVF

SEQ ID NO: 10418 - protein, 18 aa, Mus sp.
GEVKAFFESHPAPSAERT

SEQ ID NO: 10419 - protein, 17 aa, Mus sp.
YPYPTDFLGPLPANPVK

SEQ ID NO: 10420 - protein, 16 aa, Mus sp.
APMYYRGSAAAVIVYD

SEQ ID NO: 10421 - protein, 16 aa, Mus sp.
KKFRFEEPVVLPDLSD

SEQ ID NO: 10422 - protein, 14 aa, Mus sp.
VDQIYHLASPASPP

SEQ ID NO: 10423 - protein, 17 aa, Mus sp.
ELYRPSFVHPGAATVPT

SEQ ID NO: 10424 - protein, 15 aa, Mus sp.
VTEYTPRSWNFLHTL

SEQ ID NO: 10425 - protein, 15 aa, Mus sp.
EDVIAEPEGTHSFDG

SEQ ID NO: 10426 - protein, 16 aa, Mus sp.
AEIEYAMAYSKAAFER

SEQ ID NO: 10427 - protein, 18 aa, Mus sp.
VPVPEFADSDPANIVHDF

SEQ ID NO: 10428 - protein, 18 aa, Mus sp.
GRRTDWEAPTGQPSAPGP

SEQ ID NO: 10429 - protein, 13 aa, Mus sp.
FRVPTPNVSVVDL

SEQ ID NO: 10430 - protein, 20 aa, Mus sp.
RKGEQIYYAGPVNNPGLDVP

SEQ ID NO: 10431 - protein, 12 aa, Mus sp.
TDYNSPEAGNIF

SEQ ID NO: 10432 - protein, 16 aa, Mus sp.
SLQAFSNPSAGISVDV

SEQ ID NO: 10433 - protein, 18 aa, Mus sp.
VHKSFVEVNEEGTEAAAA

SEQ ID NO: 10434 - protein, 17 aa, Mus sp.
GIHHWTPPKGHVDPGEN

SEQ ID NO: 10435 - protein, 18 aa, Mus sp.
LKWKALYTDPKSSETAAF

SEQ ID NO: 10436 - protein, 19 aa, Mus sp.
GIDPYDQPNAIYIERHEPF

SEQ ID NO: 10437 - protein, 14 aa, Mus sp.
IEFRGPNGLLVYQG

SEQ ID NO: 10438 - protein, 18 aa, Mus sp.
LAPMYYRGAQAAIVVYDI

SEQ ID NO: 10439 - protein, 16 aa, Mus sp.
TSSLAAPTVEAAASAP

SEQ ID NO: 10440 - protein, 20 aa, Mus sp.
APPKPQDAFSDSQPASAAES

SEQ ID NO: 10441 - protein, 16 aa, Mus sp.
FPGQPGAPGAYPSAPG

SEQ ID NO: 10442 - protein, 22 aa, Mus sp.
WDLVDAVTPSPQPSKEEDGPPA

SEQ ID NO: 10443 - protein, 20 aa, Mus sp.
GSNLSINTNQNINIKSEPIS

SEQ ID NO: 10444 - protein, 17 aa, Mus sp.
YIEGYVPSQADVAVFEA

SEQ ID NO: 10445 - protein, 16 aa, Mus sp.
QRYSYQYTVANKEYVA

SEQ ID NO: 10446 - protein, 19 aa, Mus sp.
DIDTAAKFIGAGAATVGVA

SEQ ID NO: 10447 - protein, 17 aa, Mus sp.
KDIDSFVPSKAAPAAAA

SEQ ID NO: 10448 - protein, 15 aa, Mus sp.
IFYGASIASLSASHS

SEQ ID NO: 10449 - protein, 17 aa, Mus sp.
TGYPTAYPAAAPAYNPS

SEQ ID NO: 10450 - protein, 14 aa, Mus sp.
YYRYMNPAIVAPDA

SEQ ID NO: 10451 - protein, 17 aa, Mus sp.
GPKVNVEAPNVNMEGLG

SEQ ID NO: 10452 - protein, 25 aa, Mus sp.
KGADKTVKGPDGLTALEATDNQAIK

SEQ ID NO: 10453 - protein, 15 aa, Mus sp.
AMLQVLGPKPALPEG

SEQ ID NO: 10454 - protein, 18 aa, Mus sp.
VPDVQFKTPQISMSDIDL

SEQ ID NO: 10455 - protein, 14 aa, Mus sp.
AFRVPTPNVSVVDL

SEQ ID NO: 10456 - protein, 17 aa, Mus sp.
KEVLDYSTPTTNGTPEA

SEQ ID NO: 10457 - protein, 18 aa, Mus sp.
SVPPSVSPSPATAFSGPP

SEQ ID NO: 10458 - protein, 18 aa, Mus sp.
SYPFDFQGAKIITGQEEG

SEQ ID NO: 10459 - protein, 16 aa, Mus sp.
SLHLRFSAPQIENEPE

SEQ ID NO: 10460 - protein, 18 aa, Mus sp.
ITSSYYRGAHGIIVVYDV

SEQ ID NO: 10461 - protein, 16 aa, Mus sp.
LLAETVAPAVRGANPH

SEQ ID NO: 10462 - protein, 16 aa, Mus sp.
RTDWEAPTGQPSAPGP

SEQ ID NO: 10463 - protein, 24 aa, Mus sp.
LPNKPTVTVVSPLPNDSINPQPSP

SEQ ID NO: 10464 - protein, 19 aa, Mus sp.
KLTGMAFRVPTPNVSVVDL

SEQ ID NO: 10465 - protein, 13 aa, Mus sp.
VQPYSGSPANLAA

SEQ ID NO: 10466 - protein, 14 aa, Mus sp.
KGPAFVNPLIPENK

SEQ ID NO: 10467 - protein, 13 aa, Mus sp.
GGHKLGLGLEFQA

SEQ ID NO: 10468 - protein, 13 aa, Mus sp.
TAYASYPSASVEN

SEQ ID NO: 10469 - protein, 16 aa, Mus sp.
YIEGYVPSQADVAVFE

SEQ ID NO: 10470 - protein, 14 aa, Mus sp.
IPYQGPSSDYVVVK

SEQ ID NO: 10471 - protein, 15 aa, Mus sp.
KQREEYQPATPGLGM

SEQ ID NO: 10472 - protein, 18 aa, Mus sp.
SSIASFKDPKISTSLPVL

SEQ ID NO: 10473 - protein, 12 aa, Mus sp.
ALPYDTPVPGYM

SEQ ID NO: 10474 - protein, 16 aa, Mus sp.
YAKVELVPPTPAEIPT

SEQ ID NO: 10475 - protein, 18 aa, Mus sp.
KPSPIYISSYSSPAREQN

SEQ ID NO: 10476 - protein, 17 aa, Mus sp.
ASAYYNPGNPHNVYMPT

SEQ ID NO: 10477 - protein, 24 aa, Mus sp.
LDPAGPNFEYAEAPSRLSPDDADF

SEQ ID NO: 10478 - protein, 14 aa, Mus sp.
TVIHFNNPKVQASL

SEQ ID NO: 10479 - protein, 18 aa, Mus sp.
ITRDLKWGTPVPLEGFED

SEQ ID NO: 10480 - protein, 13 aa, Mus sp.
KFVYAGSNSGVVQ

SEQ ID NO: 10481 - protein, 15 aa, Mus sp.
GEVEWKGPWSDSSYE

SEQ ID NO: 10482 - protein, 17 aa, Mus sp.
DRNRPYVFSAPSESVEL

SEQ ID NO: 10483 - protein, 14 aa, Mus sp.
NPDFTQPISEVVDE

SEQ ID NO: 10484 - protein, 16 aa, Mus sp.
YDKYFTNPQISQGVPG

SEQ ID NO: 10485 - protein, 19 aa, Mus sp.
APGPSHTVAAPQAAAAAAL

SEQ ID NO: 10486 - protein, 17 aa, Mus sp.
YTWSDAAAPFAGLSTDQ

SEQ ID NO: 10487 - protein, 14 aa, Mus sp.
TGMAFRVPTPNVSV

SEQ ID NO: 10488 - protein, 19 aa, Mus sp.
DGEEAGAYDGPRTADGIVS

SEQ ID NO: 10489 - protein, 15 aa, Mus sp.
EPSVFNGPEVTMLKD

SEQ ID NO: 10490 - protein, 14 aa, Mus sp.
SNSYGIPEPAHAYA

SEQ ID NO: 10491 - protein, 14 aa, Mus sp.
LSRFTSGVPSFVLD

SEQ ID NO: 10492 - protein, 16 aa, Mus sp.
QGGVYASPSIAGSRPG

SEQ ID NO: 10493 - protein, 16 aa, Mus sp.
GKFIYITPEELAAVAN

SEQ ID NO: 10494 - protein, 18 aa, Mus sp.
MPDMHFKAPKISMPDVDL

SEQ ID NO: 10495 - protein, 14 aa, Mus sp.
LPYKSPGINVDSSY

SEQ ID NO: 10496 - protein, 17 aa, Mus sp.
SSPDIFDSPSPEEDKEE

SEQ ID NO: 10497 - protein, 18 aa, Mus sp.
APAPAPAAAPAPAPAAQA

SEQ ID NO: 10498 - protein, 16 aa, Mus sp.
APPHFHFGQTNRTPEF

SEQ ID NO: 10499 - protein, 18 aa, Mus sp.
IDFEDVIAEPEGTHSFDG

SEQ ID NO: 10500 - protein, 14 aa, Mus sp.
ERASFITPVPGGVG

SEQ ID NO: 10501 - protein, 14 aa, Mus sp.
SLEDFYGSPIPSVS

SEQ ID NO: 10502 - protein, 16 aa, Mus sp.
EEEYYAEPGVTEAEPV

SEQ ID NO: 10503 - protein, 14 aa, Mus sp.
ELVRAPTAALSPEP

SEQ ID NO: 10504 - protein, 17 aa, Mus sp.
RPPADFTQPAAAAAAAA

SEQ ID NO: 10505 - protein, 15 aa, Mus sp.
LEVVTDPTTNAGYVK

SEQ ID NO: 10506 - protein, 16 aa, Listeria monocytogenes
GGINQAYTGSTALSDG

SEQ ID NO: 10507 - protein, 26 aa, Mus sp.
GGLDSLIGDSNFGAPSASVAAAPAPA

SEQ ID NO: 10508 - protein, 17 aa, Mus sp.
HGSLFLKTPKIVSSKDY

SEQ ID NO: 10509 - protein, 26 aa, Mus sp.
GPSAPATPAAEAKAAEAAASAYYNPG

SEQ ID NO: 10510 - protein, 18 aa, Mus sp.
EKPVPAAPVPSPVAPAPV

SEQ ID NO: 10511 - protein, 16 aa, Mus sp.
VTRQTTQYPEANALVR

SEQ ID NO: 10512 - protein, 14 aa, Mus sp.
SSVAFIKPGVNKAE

SEQ ID NO: 10513 - protein, 20 aa, Mus sp.
KKVIEDRDHYIPNTLNPVFG

SEQ ID NO: 10514 - protein, 15 aa, Mus sp.
DPKLTYHGFTLEDAA

SEQ ID NO: 10515 - protein, 14 aa, Mus sp.
FPIKWTAPEAALYG

SEQ ID NO: 10516 - protein, 13 aa, Mus sp.
YEWAPPVQNQALA

SEQ ID NO: 10517 - protein, 18 aa, Mus sp.
IARQNFTEPTAIQAQGWP

SEQ ID NO: 10518 - protein, 17 aa, Mus sp.
SLQAFSNPSAGISVDVK

SEQ ID NO: 10519 - protein, 14 aa, Mus sp.
FPDNYNSPTPYKIQ

SEQ ID NO: 10520 - protein, 21 aa, Mus sp.
GVEAARDNMFSGSKINYTENR

SEQ ID NO: 10521 - protein, 16 aa, Mus sp.
SEWKFTITPPSAQVVG

SEQ ID NO: 10522 - protein, 22 aa, Mus sp.
VDPTPDPNTAYASYPSASVENY

SEQ ID NO: 10523 - protein, 15 aa, Mus sp.
DLLYSFPVVIKNKTW

SEQ ID NO: 10524 - protein, 14 aa, Mus sp.
VIHFNNPKVQASLA

SEQ ID NO: 10525 - protein, 15 aa, Mus sp.
GSDIFAAPAPQSTAT

SEQ ID NO: 10526 - protein, 15 aa, Mus sp.
KGSVFSAPSASGTPN

SEQ ID NO: 10527 - protein, 17 aa, Mus sp.
GQDHVDFSQPEPHTVLF

SEQ ID NO: 10528 - protein, 12 aa, Mus sp.
QPNVVISLSRTE

SEQ ID NO: 10529 - protein, 20 aa, Mus sp.
YNRDGDSYRSPWSNKYDPPL

SEQ ID NO: 10530 - protein, 16 aa, Mus sp.
SGVEWKGPQVSSSLNL

SEQ ID NO: 10531 - protein, 16 aa, Mus sp.
GEEDWTISPVPQSIVD

SEQ ID NO: 10532 - protein, 17 aa, Mus sp.
VIKSGYKIPELSQSLDY

SEQ ID NO: 10533 - protein, 15 aa, Mus sp.
EKVIVDFSSPNIAKE

SEQ ID NO: 10534 - protein, 16 aa, Mus sp.
TPTFTYKAAHIFFTDT

SEQ ID NO: 10535 - protein, 14 aa, Mus sp.
IASFKDPKISTSLP

SEQ ID NO: 10536 - protein, 21 aa, Mus sp.
EGDTYEYRVSAVNIVGQGKPS

SEQ ID NO: 10537 - protein, 15 aa, Mus sp.
APAPAEAPAAAEAPA

SEQ ID NO: 10538 - protein, 15 aa, Mus sp.
WKALYTDPKSSETAA

SEQ ID NO: 10539 - protein, 13 aa, Mus sp.
IDIFARPTAGFIT

SEQ ID NO: 10540 - protein, 17 aa, Mus sp.
EVSSVEAPSVSPARHQL

SEQ ID NO: 10541 - protein, 15 aa, Mus sp.
DIRSDWTNPEINKAV

SEQ ID NO: 10542 - protein, 12 aa, Mus sp.
TPFWMAPEVIQE

SEQ ID NO: 10543 - protein, 17 aa, Mus sp.
SAPPHFHFGQTNRTPEF

SEQ ID NO: 10544 - protein, 21 aa, Mus sp.
DEGKLLEAKGPVTDVAYSHDG

SEQ ID NO: 10545 - protein, 30 aa, Mus sp.; identical to SEQ ID NO: 3326

SEQ ID NO: 10546 - protein, 17 aa, Listeria monocytogenes
DDTTVKFTLPTVAPAFE

SEQ ID NO: 10547 - protein, 17 aa, Mus sp.
GTTVYRQFWIFDVQNPD

SEQ ID NO: 10548 - protein, 16 aa, Mus sp.
SPVTTASMSGCLSFYY

SEQ ID NO: 10549 - protein, 17 aa, Mus sp.
DSKLHHGHDPRGGLQPS

SEQ ID NO: 10550 - protein, 14 aa, Mus sp.
DFYGSPIPSVSLKL

SEQ ID NO: 10551 - protein, 14 aa, Mus sp.
VSWQEKQPEASISQ

SEQ ID NO: 10552 - protein, 18 aa, Mus sp.
NLRDNYRFAHTNIESLVK

SEQ ID NO: 10553 - protein, 18 aa, Mus sp.
TDINAFVGAVSLTAADSN

SEQ ID NO: 10554 - protein, 7 aa, Mus sp.
SIASFKD

SEQ ID NO: 10555 - protein, 10 aa, Mus sp.
LDYYDSPSVN

SEQ ID NO: 10556 - protein, 21 aa, Mus sp.
GPGEPSPVSETVVTPEAAPEK

SEQ ID NO: 10557 - protein, 18 aa, Mus sp.
IDNSKEFEFIESQTSSHR

SEQ ID NO: 10558 - protein, 16 aa, Mus sp.
RLDNYDAPDIANIAIS

SEQ ID NO: 10559 - protein, 20 aa, Mus sp.
LPDDINVYATTAANPKESSY

SEQ ID NO: 10560 - protein, 14 aa, Mus sp.
INDYKGAVIVVSHD

SEQ ID NO: 10561 - protein, 16 aa, Mus sp.
EYFVFRPGTIEQAVEE

SEQ ID NO: 10562 - protein, 14 aa, Mus sp.
DTVTISGPQAAVNE

SEQ ID NO: 10563 - protein, 18 aa, Mus sp.
EKEDRRYNPPIIHQGFQD

SEQ ID NO: 10564 - protein, 17 aa, Mus sp.
APPLPIKTPIPTPSTLP

SEQ ID NO: 10565 - protein, 19 aa, Mus sp.
RAKQIVWNGPVGVFEWEAF

SEQ ID NO: 10566 - protein, 14 aa, Mus sp.
GPPPGWEGPHPQRG

SEQ ID NO: 10567 - protein, 16 aa, Mus sp.
TPSYYTTSDAVISTET

SEQ ID NO: 10568 - protein, 13 aa, Mus sp.
GVELYRAPFPLYA

SEQ ID NO: 10569 - protein, 24 aa, Mus sp.
VPDGPEAPLDELVGAYPNYNEEEE

SEQ ID NO: 10570 - protein, 12 aa, Mus sp.
VSYYGPKTSPVQ

SEQ ID NO: 10571 - protein, 15 aa, Mus sp.
DDDVYRAPPIDRSIL

SEQ ID NO: 10572 - protein, 18 aa, Mus sp.
ASLEDFYGSPIPSVSLKL

SEQ ID NO: 10573 - protein, 17 aa, Mus sp.
SLESFLGPRANTEDLPF

SEQ ID NO: 10574 - protein, 20 aa, Mus sp.
EQRATFHTPEAPPNLAPAPP

SEQ ID NO: 10575 - protein, 16 aa, Mus sp.
VDHRGTWNGPWVSTEV

SEQ ID NO: 10576 - protein, 18 aa, Mus sp.
DPSKTGIGAPTISTGPPG

SEQ ID NO: 10577 - protein, 17 aa, Mus sp.
LEMYKVHNPVPLIVGSS

SEQ ID NO: 10578 - protein, 15 aa, Mus sp.
VKDGYQMAQPVFAPK

SEQ ID NO: 10579 - protein, 15 aa, Mus sp.
DLKWGTPVPLEGFED

SEQ ID NO: 10580 - protein, 15 aa, Mus sp.
GSTLWSSPLPEEAQD

SEQ ID NO: 10581 - protein, 16 aa, Mus sp.
SNKQYLFPETLVIGEK

SEQ ID NO: 10582 - protein, 18 aa, Mus sp.
GPLDQVRAALPTPALTPE

SEQ ID NO: 10583 - protein, 18 aa, Mus sp.
IVLQAAVPKSMKVKLQPP

SEQ ID NO: 10584 - protein, 25 aa, Mus sp.
VIPELNGKLTGMAFRVPTPNVSVVD

SEQ ID NO: 10585 - protein, 12 aa, Mus sp.
IVYWMTSQPSDA

SEQ ID NO: 10586 - protein, 18 aa, Mus sp.
NPEKHIYSSITTWETTER

SEQ ID NO: 10587 - protein, 15 aa, Mus sp.
YDLKWEFPRENLEFG

SEQ ID NO: 10588 - protein, 21 aa, Mus sp.
GEMDEATRYLAPTILTDVDPN

SEQ ID NO: 10589 - protein, 15 aa, Mus sp.
WNHRYGEPIPSTTLT

SEQ ID NO: 10590 - protein, 18 aa, Mus sp.
APGGYPAAGPYGVPAGPL

SEQ ID NO: 10591 - protein, 22 aa, Mus sp.
MEKIQASVATNPIITPVAQENQ

SEQ ID NO: 10592 - protein, 15 aa, Mus sp.
YTPYYVAPEVLGPEK

SEQ ID NO: 10593 - protein, 16 aa, Mus sp.
VADLVKNPTASLVLPE

SEQ ID NO: 10594 - protein, 17 aa, Mus sp.
NPKAEVARAQAALAVNI

SEQ ID NO: 10595 - protein, 15 aa, Mus sp.
ADPSAFAAAAPAAAA

SEQ ID NO: 10596 - protein, 15 aa, Mus sp.
TPAYTIPFYTPIPNG

SEQ ID NO: 10597 - protein, 29 aa, Mus sp.
KKVNRITGLDPAGPNFEYAEAPSRLSPDD

SEQ ID NO: 10598 - protein, 13 aa, Mus sp.
EEEKAPEVSPAQP

SEQ ID NO: 10599 - protein, 17 aa, Mus sp.
EGNHYFYSPYPTKTQTM

SEQ ID NO: 10600 - protein, 14 aa, Mus sp.
GIDPYDQPNAIYIE

SEQ ID NO: 10601 - protein, 18 aa, Mus sp.
GPVPEFSGATVERVSEDM

SEQ ID NO: 10602 - protein, 16 aa, Mus sp.
KLLEAKGPVTDVAYSH

SEQ ID NO: 10603 - protein, 17 aa, Mus sp.
SEERVYMVGKANSVFED

SEQ ID NO: 10604 - protein, 17 aa, Mus sp.
SIASFKDPKISTSLPVL

SEQ ID NO: 10605 - protein, 11 aa, Mus sp.
VLDFVTPTPLG

SEQ ID NO: 10606 - protein, 14 aa, Mus sp.
RNIYWTDSVPGSVS

SEQ ID NO: 10607 - protein, 20 aa, Mus sp.
EDGELTYENVQVSPVPGGPP

SEQ ID NO: 10608 - protein, 16 aa, Mus sp.
MAFRVPTPNVSVVDLT

SEQ ID NO: 10609 - protein, 18 aa, Mus sp.
IDTSLKAPDVDVSVAGPD

SEQ ID NO: 10610 - protein, 17 aa, Mus sp.
EAEEVYRNSMPASSFQQ

SEQ ID NO: 10611 - protein, 13 aa, Mus sp.
LPYKSPGINVDSS

SEQ ID NO: 10612 - protein, 19 aa, Mus sp.
APSEERVYMVGKANSVFED

SEQ ID NO: 10613 - protein, 16 aa, Mus sp.
ERDSKIVVPPLPGKAL

SEQ ID NO: 10614 - protein, 19 aa, Mus sp.
APETRSQVTPSVPSEALDD

SEQ ID NO: 10615 - protein, 16 aa, Mus sp.
DITHTYKYPEGSPEER

SEQ ID NO: 10616 - protein, 15 aa, Mus sp.
LQQEFQRAQAAKAPG

SEQ ID NO: 10617 - protein, 19 aa, Mus sp.
EEVGEYRQPSGGSVPVSPG

SEQ ID NO: 10618 - protein, 14 aa, Mus sp.
TAYASYPSASVENY

SEQ ID NO: 10619 - protein, 12 aa, Mus sp.
VGGERFEAPEAL

SEQ ID NO: 10620 - protein, 16 aa, Mus sp.
DGIHHWTPPKGHVDPG

SEQ ID NO: 10621 - protein, 16 aa, Mus sp.
STLIWAAPRLQSEVAE

SEQ ID NO: 10622 - protein, 19 aa, Mus sp.
YPPSGPTYRGPVPWHTINL

SEQ ID NO: 10623 - protein, 13 aa, Mus sp.
TPWKAPIVWEGTY

SEQ ID NO: 10624 - protein, 13 aa, Mus sp.
SDVIHAPLPSPVD

SEQ ID NO: 10625 - protein, 15 aa, Listeria monocytogenes
GINQAYTGSTALSDG

SEQ ID NO: 10626 - protein, 18 aa, Mus sp.
DYPYPTDFLGPLPANPVK

SEQ ID NO: 10627 - protein, 13 aa, Mus sp.
GEFDYSGSQAIKA

SEQ ID NO: 10628 - protein, 14 aa, Mus sp.
DQLEWQSNQPWEQA

SEQ ID NO: 10629 - protein, 15 aa, Mus sp.
GSVTYIAPPGNYDAS

SEQ ID NO: 10630 - protein, 17 aa, Mus sp.
IQEMEKEDRRYNPPIIH

SEQ ID NO: 10631 - protein, 14 aa, Mus sp.
DQKFYNFVVIHARA

SEQ ID NO: 10632 - protein, 15 aa, Mus sp.
GGYKFSAPVVPSSFN

SEQ ID NO: 10633 - protein, 20 aa, Mus sp.
LEDPDGFSWPATLPSVYKQP

SEQ ID NO: 10634 - protein, 19 aa, Mus sp.
EKPVPAAPVPSPVAPAPVP

SEQ ID NO: 10635 - protein, 18 aa, Mus sp.
ERLYLLAAPSAERSDWIQ

SEQ ID NO: 10636 - protein, 20 aa, Mus sp.
KGEQIYYAGPVNNPGLDVPQ

SEQ ID NO: 10637 - protein, 12 aa, Mus sp.
VDFDFAGPAIHG

SEQ ID NO: 10638 - protein, 16 aa, Mus sp.
TVTPWKAPIVWEGTYD

SEQ ID NO: 10639 - protein, 17 aa, Mus sp.
QPPEYTFPSGSGAHFPQ

SEQ ID NO: 10640 - protein, 14 aa, Mus sp.
VPVYLAGAAGLSVG

SEQ ID NO: 10641 - protein, 14 aa, Mus sp.
GQDHVDFSQPEPHT

SEQ ID NO: 10642 - protein, 17 aa, Mus sp.
ARPDDEVGPAVAPGHPL

SEQ ID NO: 10643 - protein, 16 aa, Mus sp.
EGERYIAPTVLVDVQE

SEQ ID NO: 10644 - protein, 12 aa, Mus sp.
LYNQVKDLQEQN

SEQ ID NO: 10645 - protein, 11 aa, Mus sp.
ELDYYDSPSVN

SEQ ID NO: 10646 - protein, 18 aa, Mus sp.
ITDKFWGPSGAESVIGGV

SEQ ID NO: 10647 - protein, 13 aa, Mus sp.
STTEFEEPRVIDL

SEQ ID NO: 10648 - protein, 17 aa, Mus sp.
GLDSQGCFCAGCSRQIG

SEQ ID NO: 10649 - protein, 18 aa, Mus sp.
VTTDHISPAGNIARNSPA

SEQ ID NO: 10650 - protein, 17 aa, Mus sp.
DTKVVFLSPAVPEEPEA

SEQ ID NO: 10651 - protein, 18 aa, Mus sp.
SREQFSYVLPTVHSLEPS

SEQ ID NO: 10652 - protein, 14 aa, Mus sp.
VSFVQPNGAIFEPS

SEQ ID NO: 10653 - protein, 16 aa, Mus sp.
DGIEDFVSGVPRAART

SEQ ID NO: 10654 - protein, 15 aa, Mus sp.
TSSLAAPTVEAAASA

SEQ ID NO: 10655 - protein, 17 aa, Mus sp.
EPYAHAAPESIPATFED

SEQ ID NO: 10656 - protein, 17 aa, Mus sp.
GRERYNFPNPNPFVEDD

SEQ ID NO: 10657 - protein, 16 aa, Mus sp.
SAFSYVDPVITSISPR

SEQ ID NO: 10658 - protein, 14 aa, Mus sp.
DNYRFAHTNIESLV

SEQ ID NO: 10659 - protein, 14 aa, Mus sp.
SDVIHAPLPSPVDK

SEQ ID NO: 10660 - protein, 23 aa, Mus sp.
GPSAPATPAAEAKAAEAAASAYY

SEQ ID NO: 10661 - protein, 18 aa, Mus sp.
TKNLDYVATSIHEAVTKI

SEQ ID NO: 10662 - protein, 13 aa, Mus sp.
IDYTVPTVIAEEM

SEQ ID NO: 10663 - protein, 17 aa, Mus sp.
WQPLTWTSSQPSGITVE

SEQ ID NO: 10664 - protein, 20 aa, Mus sp.
GPNDERFGVRFPAMSDAYDR

SEQ ID NO: 10665 - protein, 16 aa, Mus sp.
APNLHFHNPNPEIPAL

SEQ ID NO: 10666 - protein, 16 aa, Mus sp.
LPSTSYLPSTPSVVPA

SEQ ID NO: 10667 - protein, 15 aa, Mus sp.
VTPWKAPIVWEGTYD

SEQ ID NO: 10668 - protein, 16 aa, Mus sp.
EGPEASTPMPSPSPSP

SEQ ID NO: 10669 - protein, 19 aa, Mus sp.
SPPGGDFSDPVTSATLGIV

SEQ ID NO: 10670 - protein, 16 aa, Mus sp.
NVDPFKAVDTNRASMG

SEQ ID NO: 10671 - protein, 20 aa, Mus sp.
KNKPEDYQGGRTGEAIVDAA

SEQ ID NO: 10672 - protein, 15 aa, Mus sp.
RAGYKAAIVHNVDSD

SEQ ID NO: 10673 - protein, 17 aa, Mus sp.
KVLPTYDASKVTASGPG

SEQ ID NO: 10674 - protein, 18 aa, Mus sp.
NPTDEYLDAMMNEAPGPI

SEQ ID NO: 10675 - protein, 16 aa, Mus sp.
KPSQAGWFDQIAVKVA

SEQ ID NO: 10676 - protein, 14 aa, Mus sp.
IQFNNYQVRYRPEL

SEQ ID NO: 10677 - protein, 17 aa, Mus sp.
NNQAYHSPATALAIVDN

SEQ ID NO: 10678 - protein, 17 aa, Mus sp.
GTVIHFNNPKVQASLAA

SEQ ID NO: 10679 - protein, 15 aa, Mus sp.
GYPVLYPTGWSSSDN

SEQ ID NO: 10680 - protein, 16 aa, Mus sp.
GPEVDVSLPKANIDVS

SEQ ID NO: 10681 - protein, 12 aa, Mus sp.
VGAWTGPMGNWA

SEQ ID NO: 10682 - protein, 16 aa, Mus sp.
FTAQWIAPSVQLTGYR

SEQ ID NO: 10683 - protein, 18 aa, Mus sp.
KVEPYEVHNPVPLIVGSS

SEQ ID NO: 10684 - protein, 14 aa, Mus sp.
LDIFNLPNVEISKD

SEQ ID NO: 10685 - protein, 17 aa, Mus sp.
GPRAEEYEFLTPMEEAP

SEQ ID NO: 10686 - protein, 13 aa, Mus sp.
NERFRCPEAIFQP

SEQ ID NO: 10687 - protein, 18 aa, Mus sp.
DTSSKVIQSVANYAKGDL

SEQ ID NO: 10688 - protein, 17 aa, Mus sp.
FAISYVAALPAAALWHK

SEQ ID NO: 10689 - protein, 15 aa, Mus sp.
EDNVFEAPTLVKVFK

SEQ ID NO: 10690 - protein, 14 aa, Mus sp.
YIEGYVPSQADVAV

SEQ ID NO: 10691 - protein, 19 aa, Mus sp.
IARQNFTEPTAIQAQGWPV

SEQ ID NO: 10692 - protein, 16 aa, Mus sp.
SGLEVVAPEVTSAPVS

SEQ ID NO: 10693 - protein, 17 aa, Mus sp.
SPYAFNGGTVLAIAGED

SEQ ID NO: 10694 - protein, 20 aa, Mus sp.
GFPKPPSYNVATTLPSYDEA

SEQ ID NO: 10695 - protein, 15 aa, Mus sp.
DGNFVEATALHTAPH

SEQ ID NO: 10696 - protein, 18 aa, Mus sp.
GSILWSQPLPSLPGGPPS

SEQ ID NO: 10697 - protein, 17 aa, Mus sp.
VTEDNVFEAPTLVKVFK

SEQ ID NO: 10698 - protein, 16 aa, Listeria monocytogenes
VERWNEKYAQAYPNVS

SEQ ID NO: 10699 - protein, 16 aa, Listeria monocytogenes
DGLTWHDGKPLTADDV

SEQ ID NO: 10700 - protein, 15 aa, Mus sp.
VQPYSGSPANLAAYT

SEQ ID NO: 10701 - protein, 22 aa, Mus sp.
KHVPSGIVVKVETGGEPRSAAT

SEQ ID NO: 10702 - protein, 20 aa, Mus sp.
IDNSKEFEFIESQTSSHRIN

SEQ ID NO: 10703 - protein, 16 aa, Mus sp.
APLPPWKTPSSSQPPP

SEQ ID NO: 10704 - protein, 17 aa, Mus sp.
DKEKVIVDFSSPNIAKE

SEQ ID NO: 10705 - protein, 16 aa, Mus sp.
DSNFGAPSASVAAAPA

SEQ ID NO: 10706 - protein, 16 aa, Mus sp.
QASIYSPPAAAAAAAA

SEQ ID NO: 10707 - protein, 12 aa, Mus sp.
YRGAQAAIVVYD

SEQ ID NO: 10708 - protein, 12 aa, Mus sp.
LKYHFVTPLTSM

SEQ ID NO: 10709 - protein, 11 aa, Mus sp.
FPYVTPAPHEP

SEQ ID NO: 10710 - protein, 15 aa, Mus sp.
DIDSFVPSKAAPAAA

SEQ ID NO: 10711 - protein, 14 aa, Mus sp.
RRYNPPIIHQGFQD

SEQ ID NO: 10712 - protein, 18 aa, Mus sp.
SAVKSKYKASIAALEAKI

SEQ ID NO: 10713 - protein, 16 aa, Mus sp.
EDNVYHSSNAVYRAPS

SEQ ID NO: 10714 - protein, 18 aa, Mus sp.
LPPHVYSTPQPSLPPVQP

SEQ ID NO: 10715 - protein, 16 aa, Mus sp.
GKWKYEKPDGSPVFIA

SEQ ID NO: 10716 - protein, 15 aa, Mus sp.
LFEDNMALPSESVSS

SEQ ID NO: 10717 - protein, 17 aa, Mus sp.
GPKVDIEGPNVNIEGPE

SEQ ID NO: 10718 - protein, 15 aa, Mus sp.
VVIEVFTPVVQRILK

SEQ ID NO: 10719 - protein, 17 aa, Mus sp.
LEEKGVYVQASTLGSLE

SEQ ID NO: 10720 - protein, 15 aa, Mus sp.
IGDESVGRVVFGLFG

SEQ ID NO: 10721 - protein, 13 aa, Mus sp.
LPAAAQAPDALPA

SEQ ID NO: 10722 - protein, 16 aa, Mus sp.
EGDIFIGPKAEEHRGL

SEQ ID NO: 10723 - protein, 16 aa, Mus sp.
TEDNVFEAPTLVKVFK

SEQ ID NO: 10724 - protein, 16 aa, Mus sp.
GDISISGPKVNVEAPN

SEQ ID NO: 10725 - protein, 16 aa, Mus sp.
GREVSSVEAPSVSPAR

SEQ ID NO: 10726 - protein, 15 aa, Mus sp.
LVEALEQPAPAIVSA

SEQ ID NO: 10727 - protein, 19 aa, Listeria monocytogenes
SNVNHVLDIGYGGGSNVKN

SEQ ID NO: 10728 - protein, 25 aa, Mus sp.
APAPAAPAAAEPQAEAPAAAASSEQ

SEQ ID NO: 10729 - protein, 29 aa, Mus sp.
NVDPFKAVDTNRASMGQASPESKGFTDLL

SEQ ID NO: 10730 - protein, 16 aa, Mus sp.
SARTVITPDPNLSIDQ

SEQ ID NO: 10731 - protein, 20 aa, Mus sp.
GNPLNSVFVAPAVTPVKGVL

SEQ ID NO: 10732 - protein, 19 aa, Mus sp.
TPRVLSQAPSPLYSVEFSE

SEQ ID NO: 10733 - protein, 18 aa, Mus sp.
AGPNFEYAEAPSRLSPDD

SEQ ID NO: 10734 - protein, 17 aa, Mus sp.
GEVKAFFESHPAPSAER

SEQ ID NO: 10735 - protein, 16 aa, Mus sp.
GRPDAEYWNSQPEILE

SEQ ID NO: 10736 - protein, 24 aa, Mus sp.
YTAKGLFRAAVPSGASTGIYEALE

SEQ ID NO: 10737 - protein, 15 aa, Mus sp.
ADASFVAAIPSTQVV

SEQ ID NO: 10738 - protein, 17 aa, Mus sp.
LPQDPTFHTPLDLYAYA

SEQ ID NO: 10739 - protein, 19 aa, Mus sp.
EPPQVPAEAPQPRASEDSP

SEQ ID NO: 10740 - protein, 16 aa, Mus sp.
ARDNMFSGSKINYTEN

SEQ ID NO: 10741 - protein, 16 aa, Mus sp.
IDNPDYKGTWIHPEID

SEQ ID NO: 10742 - protein, 15 aa, Mus sp.
IVYWMTSQPSDAVRF

SEQ ID NO: 10743 - protein, 14 aa, Mus sp.
FEVQWQSAEPGSTP

SEQ ID NO: 10744 - protein, 13 aa, Mus sp.
NIYWTDSVPGSVS

SEQ ID NO: 10745 - protein, 19 aa, Mus sp.
QPTGPPPYHESLAGASQPP

SEQ ID NO: 10746 - protein, 16 aa, Mus sp.
TPPPAAAPIPAPSTEE

SEQ ID NO: 10747 - protein, 18 aa, Mus sp.
GNRITPSYVAFTPEGERL

SEQ ID NO: 10748 - protein, 16 aa, Mus sp.
LPENFRRPQTDQAVEF

SEQ ID NO: 10749 - protein, 14 aa, Mus sp.
LEPYLEPRSPEARG

SEQ ID NO: 10750 - protein, 20 aa, Mus sp.
SPPHVQFTYQQPQPLSVEPR

SEQ ID NO: 10751 - protein, 17 aa, Mus sp.
FPPEFYEHAKALWEDEG

SEQ ID NO: 10752 - protein, 17 aa, Mus sp.
NPGDGAFYGPKIDIQIK

SEQ ID NO: 10753 - protein, 14 aa, Mus sp.
INYQPPTVVPGGDL

SEQ ID NO: 10754 - protein, 26 aa, Mus sp.
APAPAAPAAAEPQAEAPAAAASSEQS

SEQ ID NO: 10755 - protein, 16 aa, Mus sp.
DHRGTWNGPWVSTEVL

SEQ ID NO: 10756 - protein, 18 aa, Mus sp.
APSEERVYMVGKANSVFE

SEQ ID NO: 10757 - protein, 17 aa, Mus sp.
INKMDDPTVNWSNERYE

SEQ ID NO: 10758 - protein, 25 aa, Mus sp.
ANLMEKIQASVATNPIITPVAQENQ

SEQ ID NO: 10759 - protein, 14 aa, Mus sp.
DLDETRQAIVNAAK

SEQ ID NO: 10760 - protein, 13 aa, Mus sp.
GERFEAPEALFQP

SEQ ID NO: 10761 - protein, 16 aa, Mus sp.
SEEEYSAPLPTPAPSS

SEQ ID NO: 10762 - protein, 19 aa, Mus sp.
SPVRFSTETTFLVDKYEIL

SEQ ID NO: 10763 - protein, 18 aa, Mus sp.
TGVPTVPLLPPQVNQSLA

SEQ ID NO: 10764 - protein, 18 aa, Listeria monocytogenes
GLLMAKKYKMNLTIVIVN

SEQ ID NO: 10765 - protein, 17 aa, Mus sp.
LKRSYSSPDITQALQEE

SEQ ID NO: 10766 - protein, 15 aa, Mus sp.
IGVGAYVSPDMMVAE

SEQ ID NO: 10767 - protein, 15 aa, Mus sp.
LGDVFLGPYVAVFDR

SEQ ID NO: 10768 - protein, 15 aa, Mus sp.
VDPFKAVDTNRASMG

SEQ ID NO: 10769 - protein, 13 aa, Mus sp.
EFMGPEVAPALPD

SEQ ID NO: 10770 - protein, 15 aa, Mus sp.
NNIPYFETSAKEAIN

SEQ ID NO: 10771 - protein, 21 aa, Mus sp.
KPTVTVVSPLPNDSINPQPSP

SEQ ID NO: 10772 - protein, 15 aa, Mus sp.
YLNEYGAPDAGGLEH

SEQ ID NO: 10773 - protein, 11 aa, Mus sp.
HPIQWNAPEPS

SEQ ID NO: 10774 - protein, 15 aa, Mus sp.
GPGSAVSPYPSFNVS

SEQ ID NO: 10775 - protein, 16 aa, Mus sp.
EFSFWNEPVPRPGPNI

SEQ ID NO: 10776 - protein, 16 aa, Mus sp.
ITNQYNSPTGLYSSEN

SEQ ID NO: 10777 - protein, 18 aa, Mus sp.
EQPGLNGAAAAAAAEAPD

SEQ ID NO: 10778 - protein, 18 aa, Mus sp.
GAEIEYAMAYSKAAFERE

SEQ ID NO: 10779 - protein, 15 aa, Mus sp.
ETETVFAPVIQAGME

SEQ ID NO: 10780 - protein, 15 aa, Mus sp.
VEPYEVHNPVPLIVG

SEQ ID NO: 10781 - protein, 21 aa, Mus sp.
GPDGKGMNPPSYYTQPVPVPN

SEQ ID NO: 10782 - protein, 16 aa, Mus sp.
IPQAERYQEALPTVAN

SEQ ID NO: 10783 - protein, 13 aa, Mus sp.
QEVLAPQVVLSLG

SEQ ID NO: 10784 - protein, 19 aa, Mus sp.
GFPKPPSYNVATTLPSYDE

SEQ ID NO: 10785 - protein, 15 aa, Mus sp.
ELVRAPTAALSPEPQ

SEQ ID NO: 10786 - protein, 14 aa, Mus sp.
FPIKWTAPEAINFG

SEQ ID NO: 10787 - protein, 12 aa, Mus sp.
VPIVEPEILPDG

SEQ ID NO: 10788 - protein, 17 aa, Mus sp.
TVIHFNNPKVQASLAAN

SEQ ID NO: 10789 - protein, 16 aa, Mus sp.
GSVTYIAPPGNYDASD

SEQ ID NO: 10790 - protein, 16 aa, Mus sp.
SSIASFKDPKISTSLP

SEQ ID NO: 10791 - protein, 10 aa, Mus sp.
ALPKAVVKLD

SEQ ID NO: 10792 - protein, 13 aa, Mus sp.
VQNYPVVSIEDPF

SEQ ID NO: 10793 - protein, 16 aa, Mus sp.
VKSKYKASIAALEAKI

SEQ ID NO: 10794 - protein, 18 aa, Listeria monocytogenes
GGINQAYTGSTALSDGLN

SEQ ID NO: 10795 - protein, 28 aa, Mus sp.
KVIPELNGKLTGMAFRVPTPNVSVVDLT

SEQ ID NO: 10796 - protein, 13 aa, Mus sp.
GGLPDYSAPNPIK

SEQ ID NO: 10797 - protein, 15 aa, Mus sp.
TAQYKCPVAMEEADD

SEQ ID NO: 10798 - protein, 15 aa, Mus sp.
RNYEYYASHVPESVK

SEQ ID NO: 10799 - protein, 13 aa, Mus sp.
SSIYYISSTIAYA

SEQ ID NO: 10800 - protein, 18 aa, Mus sp.
DDGTVIHFNNPKVQASLS

SEQ ID NO: 10801 - protein, 16 aa, Mus sp.
LQFGYNTGVINAPQKV

SEQ ID NO: 10802 - protein, 15 aa, Mus sp.
AVNWYAPLVAPISKD

SEQ ID NO: 10803 - protein, 17 aa, Mus sp.
VAPKETTIWVSPSPILE

SEQ ID NO: 10804 - protein, 17 aa, Mus sp.
SEDNVYHSSNAVYRAPS

SEQ ID NO: 10805 - protein, 13 aa, Mus sp.
LDWQYPGSRGSPP

SEQ ID NO: 10806 - protein, 16 aa, Mus sp.
TEDDYNEPTVHFAEDT

SEQ ID NO: 10807 - protein, 17 aa, Mus sp.
TPSSPSYSPSSPSYSPT

SEQ ID NO: 10808 - protein, 20 aa, Mus sp.
EPSPVSETVVTPEAAPEKNP

SEQ ID NO: 10809 - protein, 16 aa, Mus sp.
AVKSKYKASIAALEAK

SEQ ID NO: 10810 - protein, 19 aa, Mus sp.
KEDRRYNPPIIHQGFQDTS

SEQ ID NO: 10811 - protein, 15 aa, Mus sp.
FVHFFAPQGLPVVPK

SEQ ID NO: 10812 - protein, 17 aa, Mus sp.
NPDYKGTWIHPEIDNPE

SEQ ID NO: 10813 - protein, 15 aa, Mus sp.
SLLYNVPAVAEEIQD

SEQ ID NO: 10814 - protein, 16 aa, Mus sp.
IDPYDQPNAIYIERHE

SEQ ID NO: 10815 - protein, 16 aa, Mus sp.
EEKYTVIYPYTARDQD

SEQ ID NO: 10816 - protein, 14 aa, Mus sp.
APGGYVAPKAVWLP

SEQ ID NO: 10817 - protein, 14 aa, Mus sp.
SSIASFKDPKISTS

SEQ ID NO: 10818 - protein, 16 aa, Mus sp.
GTKRYMAPEVLDDSIN

SEQ ID NO: 10819 - protein, 14 aa, Mus sp.
ASPELTSPLANQSL

SEQ ID NO: 10820 - protein, 11 aa, Mus sp.
AEYWNSQPEIL

SEQ ID NO: 10821 - protein, 30 aa, Mus sp.; identical to SEQ ID NO: 2486

SEQ ID NO: 10822 - protein, 16 aa, Mus sp.
VYIFYGASIASLSASH

SEQ ID NO: 10823 - protein, 14 aa, Mus sp.
NYEYYASHVPESVK

SEQ ID NO: 10824 - protein, 16 aa, Mus sp.
TPESFLGPNAALVDLD

SEQ ID NO: 10825 - protein, 17 aa, Mus sp.
IDLKGIPVYRFVLPANA

SEQ ID NO: 10826 - protein, 12 aa, Mus sp.
LIRNGDWTFQVL

SEQ ID NO: 10827 - protein, 17 aa, Mus sp.
AGALAASAPVVAVAGLG

SEQ ID NO: 10828 - protein, 14 aa, Mus sp.
RSYSSPDITQALQE

SEQ ID NO: 10829 - protein, 16 aa, Mus sp.
DWLRYSPAYAHLVAPG

SEQ ID NO: 10830 - protein, 12 aa, Mus sp.
TENGYSYPVVSY

SEQ ID NO: 10831 - protein, 15 aa, BOVIN
GAEAEAPSAVPDAAG

SEQ ID NO: 10832 - protein, 16 aa, Mus sp.
GIFTFEEPVTHVSESI

SEQ ID NO: 10833 - protein, 16 aa, Mus sp.
SNDVHMYLPTKLFQPS

SEQ ID NO: 10834 - protein, 19 aa, Mus sp.
NPTDEYLDAMMNEAPGPIN

SEQ ID NO: 10835 - protein, 24 aa, Mus sp.
EKWEETELDQLFSGPLPGRLPVNH

SEQ ID NO: 10836 - protein, 13 aa, Mus sp.
DFVAWATGEPNFA

SEQ ID NO: 10837 - protein, 16 aa, Mus sp.
VLEMYKVHNPVPLIVG

SEQ ID NO: 10838 - protein, 16 aa, Mus sp.
AIVDPYNNPVPRGLEA

SEQ ID NO: 10839 - protein, 22 aa, Mus sp.
AIEDDSGRETDSSSAPAVTPSK

SEQ ID NO: 10840 - protein, 16 aa, Mus sp.
TKNLDYVATSIHEAVT

SEQ ID NO: 10841 - protein, 16 aa, Mus sp.
QNAWFLPAQADIVATK

SEQ ID NO: 10842 - protein, 18 aa, Mus sp.
TEQTYWQATPFRAVAEPG

SEQ ID NO: 10843 - protein, 24 aa, Mus sp.
NVDPFKAVDTNRASMGQASPESKG

SEQ ID NO: 10844 - protein, 16 aa, Mus sp.
SIKEKYNSFWIGLSYT

SEQ ID NO: 10845 - protein, 13 aa, Mus sp.
KWKYEKPDGSPVF

SEQ ID NO: 10846 - protein, 15 aa, Mus sp.
KDGYQMAQPVFAPKN

SEQ ID NO: 10847 - protein, 14 aa, Mus sp.
QEVLAPQVVLSLGG

SEQ ID NO: 10848 - protein, 23 aa, Mus sp.
ASFDPQGGLQNIAVVKHNLGVLT

SEQ ID NO: 10849 - protein, 15 aa, Mus sp.
EEAFHPREMKAEDED

SEQ ID NO: 10850 - protein, 16 aa, Mus sp.
AAPASAPTPSTPAPTP

SEQ ID NO: 10851 - protein, 14 aa, Mus sp.
EPPPAYEPPAPAPA

SEQ ID NO: 10852 - protein, 13 aa, Mus sp.
SDEGERYIAPTVL

SEQ ID NO: 10853 - protein, 15 aa, Mus sp.
LKYHFVTPLTSMVVT

SEQ ID NO: 10854 - protein, 18 aa, Mus sp.
VLEMYKVHNPVPLIVGSS

SEQ ID NO: 10855 - protein, 15 aa, Listeria monocytogenes
YPGSDETPPVVNPGE

SEQ ID NO: 10856 - protein, 14 aa, Mus sp.
WKFTITPPSAQVVG

SEQ ID NO: 10857 - protein, 19 aa, Mus sp.
SDMNDAYLGYASAVILRNR

SEQ ID NO: 10858 - protein, 17 aa, Mus sp.
AGEEDWTISPVPQSIVD

SEQ ID NO: 10859 - protein, 15 aa, Mus sp.
AAPASAPTPSTPAPT

SEQ ID NO: 10860 - protein, 16 aa, Mus sp.
AQAAMEEPVVQPSVVD

SEQ ID NO: 10861 - protein, 19 aa, Mus sp.
LPDDINVYATTAANPKESS

SEQ ID NO: 10862 - protein, 30 aa, Mus sp.; identical to SEQ ID NO: 1868

SEQ ID NO: 10863 - protein, 16 aa, Mus sp.
INDYKGAVIVVSHDAR

SEQ ID NO: 10864 - protein, 15 aa, Mus sp.
IEEIEVAPPKAHEVR

SEQ ID NO: 10865 - protein, 17 aa, Mus sp.
IEDRDHYIPNTLNPVFG

SEQ ID NO: 10866 - protein, 16 aa, Mus sp.
DPNTAYASYPSASVEN

SEQ ID NO: 10867 - protein, 15 aa, Mus sp.
FDYSGSQAIKALKEE

SEQ ID NO: 10868 - protein, 16 aa, Mus sp.
TWSDAAAPFAGLSTDQ

SEQ ID NO: 10869 - protein, 20 aa, Mus sp.
VQIPKVVKSPSSLPAKPLVP

SEQ ID NO: 10870 - protein, 13 aa, Mus sp.
RKIVYEGPELNHA

SEQ ID NO: 10871 - protein, 14 aa, Mus sp.
VPWNFHEPQPGQYE

SEQ ID NO: 10872 - protein, 20 aa, Mus sp.
EKPVPAAPVPSPVAPAPVPS

SEQ ID NO: 10873 - protein, 15 aa, Mus sp.
TPERLNSPVTIPAVM

SEQ ID NO: 10874 - protein, 15 aa, Mus sp.
YGYHVNSPQVWSEPS

SEQ ID NO: 10875 - protein, 18 aa, Mus sp.
GADKTVKGPDGLTALEAT

SEQ ID NO: 10876 - protein, 18 aa, Mus sp.
LITGVDFIGSTVGLAKVS

SEQ ID NO: 10877 - protein, 14 aa, Mus sp.
DIRSDWTNPEINKA

SEQ ID NO: 10878 - protein, 17 aa, Mus sp.
SPTGNIFFSPFSISSAL

SEQ ID NO: 10879 - protein, 17 aa, Mus sp.
TKVEPYEVHNPVPLIVG

SEQ ID NO: 10880 - protein, 15 aa, Mus sp.
NPPSYYTQPVPVPNA

SEQ ID NO: 10881 - protein, 19 aa, Mus sp.
TPPSPKVTYKAPVPTGEVY

SEQ ID NO: 10882 - protein, 16 aa, Mus sp.
TLPPVSPPKAALSVDE

SEQ ID NO: 10883 - protein, 18 aa, Mus sp.
KLTGMAFRVPTPNVSVVD

SEQ ID NO: 10884 - protein, 18 aa, Mus sp.
VPIYEGYALPHAILRLDL

SEQ ID NO: 10885 - protein, 15 aa, Mus sp.
INKMDDPTVNWSNER

SEQ ID NO: 10886 - protein, 19 aa, Mus sp.
FIHKSVVEVNEEGTEAAAA

SEQ ID NO: 10887 - protein, 11 aa, Mus sp.
YTIPFYTPIPN

SEQ ID NO: 10888 - protein, 20 aa, Mus sp.
KNPTDAYLDAMMNEAPGPIN

SEQ ID NO: 10889 - protein, 13 aa, Mus sp.
TVIHFNNPKVQAS

SEQ ID NO: 10890 - protein, 17 aa, Mus sp.
APAPEFTAAQPEVADWS

SEQ ID NO: 10891 - protein, 16 aa, Mus sp.
KADDIVGPVTHEIFEN

SEQ ID NO: 10892 - protein, 17 aa, Mus sp.
VPDVDISSPGINVEAPD

SEQ ID NO: 10893 - protein, 15 aa, Mus sp.
GNVYIHPTAKVAPSA

SEQ ID NO: 10894 - protein, 18 aa, Mus sp.
SSSIASFKDPKISTSLPV

SEQ ID NO: 10895 - protein, 15 aa, Mus sp.
GPKVNVEAPNVNMEG

SEQ ID NO: 10896 - protein, 16 aa, Mus sp.
DDPIWRGPLPSNGVMH

SEQ ID NO: 10897 - protein, 14 aa, Mus sp.
AVKSKYKASIAALE

SEQ ID NO: 10898 - protein, 16 aa, Mus sp.
ISALFVTPKTAGAQVV

SEQ ID NO: 10899 - protein, 12 aa, Mus sp.
EPYLEPRSPEAR

SEQ ID NO: 10900 - protein, 27 aa, Mus sp.
YVDPTPDPNTAYASYPSASVENYQQPP

SEQ ID NO: 10901 - protein, 13 aa, Mus sp.
SIVYWMTSQPSDA

SEQ ID NO: 10902 - protein, 25 aa, Mus sp.
KDESGFPKPPSYNVATTLPSYDEAE

SEQ ID NO: 10903 - protein, 15 aa, Mus sp.
NQLEALVGPEANVGP

SEQ ID NO: 10904 - protein, 20 aa, Mus sp.
LIGRTWNDPSVQQDIKFLPF

SEQ ID NO: 10905 - protein, 15 aa, Mus sp.
SPYAFNGGTVLAIAG

SEQ ID NO: 10906 - protein, 16 aa, Mus sp.
ITDKFWGPSGAESVIG

SEQ ID NO: 10907 - protein, 17 aa, Mus sp.
APVEGASPTSISAVDGL

SEQ ID NO: 10908 - protein, 13 aa, Mus sp.
VTQFHPPHIEIQM

SEQ ID NO: 10909 - protein, 17 aa, Mus sp.
GQGVFREATTEFSVDAR

SEQ ID NO: 10910 - protein, 14 aa, Mus sp.
RTWNDPSVQQDIKF

SEQ ID NO: 10911 - protein, 15 aa, Mus sp.
SLVSWVGSEPMPEAG

SEQ ID NO: 10912 - protein, 16 aa, Mus sp.
LDKDSFSDPYAHVSFL

SEQ ID NO: 10913 - protein, 16 aa, Mus sp.
DPWTAWNAPKPGNWDS

SEQ ID NO: 10914 - protein, 17 aa, Mus sp.
VPKHEYTYPYVDSSDFG

SEQ ID NO: 10915 - protein, 16 aa, Mus sp.
DKDSFSDPYAHVSFLH

SEQ ID NO: 10916 - protein, 13 aa, Mus sp.
QIDYTVPTVIAEE

SEQ ID NO: 10917 - protein, 13 aa, Mus sp.
YLVYQEPIPTAQL

SEQ ID NO: 10918 - protein, 13 aa, Mus sp.
DQLEWQSNQPWEQ

SEQ ID NO: 10919 - protein, 21 aa, Mus sp.
GPEAPLDELVGAYPNYNEEEE

SEQ ID NO: 10920 - protein, 14 aa, Mus sp.
GAWTGPMGNWAMFT

SEQ ID NO: 10921 - protein, 15 aa, Mus sp.
DPTNPFRFPNIGVEK

SEQ ID NO: 10922 - protein, 17 aa, Mus sp.
GPGSAVSPYPSFNVSSD

SEQ ID NO: 10923 - protein, 13 aa, Mus sp.
VDFDFAGPAIHGS

SEQ ID NO: 10924 - protein, 13 aa, Mus sp.
DGYQMAQPVFAPK

SEQ ID NO: 10925 - protein, 17 aa, Mus sp.
VDAGNAFKKADPQEAIN

SEQ ID NO: 10926 - protein, 15 aa, Mus sp.
ANPDFTQPISEVVDE

SEQ ID NO: 10927 - protein, 15 aa, Mus sp.
VGGERFEAPEALFQP

SEQ ID NO: 10928 - protein, 11 aa, Mus sp.
TLVTYVPVTTF

SEQ ID NO: 10929 - protein, 15 aa, Mus sp.
FYLALPPTVYEAVTK

SEQ ID NO: 10930 - protein, 15 aa, Mus sp.
SELLRSAQPASAEPR

SEQ ID NO: 10931 - protein, 12 aa, Mus sp.
DEGERYIAPTVL

SEQ ID NO: 10932 - protein, 17 aa, Mus sp.
DSGGFYISPRSTFSSLQ

SEQ ID NO: 10933 - protein, 19 aa, Mus sp.
TPAAPTSALGPKASPAPSH

SEQ ID NO: 10934 - protein, 17 aa, Mus sp.
CFPPSERFMKYLLNFIS

SEQ ID NO: 10935 - protein, 14 aa, Mus sp.
SSPYNPPDLEEAAK

SEQ ID NO: 10936 - protein, 21 aa, Mus sp.
GQDHVDFSQPEPHTVLFHEPG

SEQ ID NO: 10937 - protein, 16 aa, Mus sp.
SLKYHFVTPLTSMVVT

SEQ ID NO: 10938 - protein, 14 aa, Mus sp.
WTFSTTGALESAVA

SEQ ID NO: 10939 - protein, 17 aa, Mus sp.
SGALLLNAPVVSITQGR

SEQ ID NO: 10940 - protein, 20 aa, Mus sp.
GKLTGMAFRVPTPNVSVVDL

SEQ ID NO: 10941 - protein, 16 aa, Mus sp.
ETETVFAPVIQAGMEA

SEQ ID NO: 10942 - protein, 19 aa, Mus sp.
AGEVKAFFESHPAPSAERT

SEQ ID NO: 10943 - protein, 18 aa, Mus sp.
SPPPGGYGQPSVLPGGYP

SEQ ID NO: 10944 - protein, 17 aa, Mus sp.
GEQSWIQALPSVAKEEK

SEQ ID NO: 10945 - protein, 13 aa, Mus sp.
IYEGYALPHAILR

SEQ ID NO: 10946 - protein, 15 aa, Mus sp.
SFVDYQTTMVRTAKA

SEQ ID NO: 10947 - protein, 19 aa, Mus sp.
VDSPDVVYSPETIEARYEY

SEQ ID NO: 10948 - protein, 14 aa, Mus sp.
IDQYQGADAVGLEE

SEQ ID NO: 10949 - protein, 16 aa, Mus sp.
VPNYKLITPAVVSERL

SEQ ID NO: 10950 - protein, 13 aa, Mus sp.
HIEVWERPLSNLA

SEQ ID NO: 10951 - protein, 13 aa, Mus sp.
SVFVAPAVTPVKG

SEQ ID NO: 10952 - protein, 15 aa, Mus sp.
TENGYSYPVVSYWVD

SEQ ID NO: 10953 - protein, 13 aa, Mus sp.
GPVPWLGPQTDEA

SEQ ID NO: 10954 - protein, 14 aa, Mus sp.
FDYSGSQAIKALKE

SEQ ID NO: 10955 - protein, 19 aa, Mus sp.
NFHQRFESPDSQASAEQPE

SEQ ID NO: 10956 - protein, 13 aa, Mus sp.
APMYYRGAQAAIV

SEQ ID NO: 10957 - protein, 15 aa, Mus sp.
APSWHASVPTRAGPD

SEQ ID NO: 10958 - protein, 22 aa, Mus sp.
EPSPVSETVVTPEAAPEKNPVD

SEQ ID NO: 10959 - protein, 16 aa, Mus sp.
DFDEEYFSSTSELAKD

SEQ ID NO: 10960 - protein, 16 aa, Mus sp.
LDEYLNSPLPDEIDEN

SEQ ID NO: 10961 - protein, 22 aa, Mus sp.
EQLPNVQVEGPTPNRPRKQLPS

SEQ ID NO: 10962 - protein, 16 aa, Mus sp.
IEEVYYDHLRCAFKSP

SEQ ID NO: 10963 - protein, 15 aa, Mus sp.
DSQYRASAPNSHVPL

SEQ ID NO: 10964 - protein, 18 aa, Mus sp.
NPTDAYLDAMMNEAPGPI

SEQ ID NO: 10965 - protein, 18 aa, Mus sp.
SPPPYAAYATPTPEVYGY

SEQ ID NO: 10966 - protein, 13 aa, Mus sp.
LEDFYGSPIPSVS

SEQ ID NO: 10967 - protein, 13 aa, Mus sp.
LPYDTPVPGYMNN

SEQ ID NO: 10968 - protein, 18 aa, Mus sp.
LTGMAFRVPTPNVSVVDL

SEQ ID NO: 10969 - protein, 15 aa, Mus sp.
IPPTHYAASRAASVA

SEQ ID NO: 10970 - protein, 16 aa, Mus sp.
DKQREEYQPATPGLGM

SEQ ID NO: 10971 - protein, 16 aa, Mus sp.
VKARVANPSGNLTDTY

SEQ ID NO: 10972 - protein, 15 aa, Mus sp.
RERYNFPNPNPFVED

SEQ ID NO: 10973 - protein, 19 aa, Mus sp.
LPQEKYVTSAPMPEPGAPG

SEQ ID NO: 10974 - protein, 13 aa, Mus sp.
LALPYDTPVPGYM

SEQ ID NO: 10975 - protein, 14 aa, Mus sp.
VGGERFEAPEALFQ

SEQ ID NO: 10976 - protein, 19 aa, Mus sp.
EDYVELPPSVSQAATSPPG

SEQ ID NO: 10977 - protein, 13 aa, Mus sp.
LGEFDTPEAIWSS

SEQ ID NO: 10978 - protein, 14 aa, Mus sp.
LVLDFVTPTPLGTR

SEQ ID NO: 10979 - protein, 16 aa, Mus sp.
TAKGLFRAAVPSGAST

SEQ ID NO: 10980 - protein, 15 aa, Mus sp.
LKRSYSSPDITQALQ

SEQ ID NO: 10981 - protein, 16 aa, Mus sp.
IPKVVKSPSSLPAKPL

SEQ ID NO: 10982 - protein, 13 aa, Mus sp.
EDFYGSPIPSVSL

SEQ ID NO: 10983 - protein, 15 aa, Mus sp.
TPRDYYFALAHTVRD

SEQ ID NO: 10984 - protein, 15 aa, Mus sp.
SDPRWAESVPQEAPG

SEQ ID NO: 10985 - protein, 23 aa, Mus sp.
APAATDEAAASAAPAASPEPQPE

SEQ ID NO: 10986 - protein, 15 aa, Mus sp.
TEEKYHEALAKGDVT

SEQ ID NO: 10987 - protein, 23 aa, Mus sp.
VPDGPEAPLDELVGAYPNYNEEE

SEQ ID NO: 10988 - protein, 15 aa, Mus sp.
NLRDNYRFAHTNIES

SEQ ID NO: 10989 - protein, 17 aa, Mus sp.
DEDIILKAPIAAPEPEL

SEQ ID NO: 10990 - protein, 16 aa, Mus sp.
SYPFDFQGAKIITGQE

SEQ ID NO: 10991 - protein, 14 aa, Mus sp.
LVQTYVGAISNGSL

SEQ ID NO: 10992 - protein, 16 aa, Mus sp.
GTPDYISPEVLKSQGG

SEQ ID NO: 10993 - protein, 8 aa, Mus sp.
AVYTFETL

SEQ ID NO: 10994 - protein, 15 aa, Mus sp.
VADKEFHAPLIIDEN

SEQ ID NO: 10995 - protein, 11 aa, Mus sp.
RYMAPEVLDDS

SEQ ID NO: 10996 - protein, 25 aa, Mus sp.
LPNKPTVTVVSPLPNDSINPQPSPD

SEQ ID NO: 10997 - protein, 12 aa, Mus sp.
WKYEKPDGSPVF

SEQ ID NO: 10998 - protein, 17 aa, Mus sp.
KILDMFVNPTSSLAYFN

SEQ ID NO: 10999 - protein, 16 aa, Mus sp.
ADPSAFAAAAPAAAAT

SEQ ID NO: 11000 - protein, 16 aa, Mus sp.
YPENWRAFKALIAAQY

SEQ ID NO: 11001 - protein, 24 aa, Mus sp.
YVDPTPDPNTAYASYPSASVENYQ

SEQ ID NO: 11002 - protein, 15 aa, Mus sp.
ARDNMFSGSKINYTE

SEQ ID NO: 11003 - protein, 17 aa, Mus sp.
SPTVHFTPAEISRSVFE

SEQ ID NO: 11004 - protein, 14 aa, Mus sp.
SKTVYALPTIAFAF

SEQ ID NO: 11005 - protein, 17 aa, Mus sp.
EAQVEFMASHGNEAARA

SEQ ID NO: 11006 - protein, 17 aa, Mus sp.
LTVTPWKAPIVWEGTYD

SEQ ID NO: 11007 - protein, 18 aa, Mus sp.
SLKYHFVTPLTSMVVTKP

SEQ ID NO: 11008 - protein, 12 aa, Mus sp.
NSEFDPPGPNVA

SEQ ID NO: 11009 - protein, 17 aa, Mus sp.
LSLLYNVPAVAEEIQDE

SEQ ID NO: 11010 - protein, 19 aa, Mus sp.
ITRDLKWGTPVPLEGFEDK

SEQ ID NO: 11011 - protein, 24 aa, Mus sp.
KPFPWGDGNHTLFHNPHVNPLPTG

SEQ ID NO: 11012 - protein, 15 aa, Mus sp.
YYLPYKSPGINVDSS

SEQ ID NO: 11013 - protein, 15 aa, Mus sp.
ATLEIKGPQADLIDA

SEQ ID NO: 11014 - protein, 18 aa, Mus sp.
TRSQVTPSVPSEALDDST

SEQ ID NO: 11015 - protein, 17 aa, Mus sp.
SYPFDFQGAKIITGQEE

SEQ ID NO: 11016 - protein, 16 aa, Mus sp.
DDLQPWHPFGVDSVPA

SEQ ID NO: 11017 - protein, 16 aa, Mus sp.
EQFSYVLPTVHSLEPS

SEQ ID NO: 11018 - protein, 19 aa, Mus sp.
KKFGNSEFDPPGPNVATTT

SEQ ID NO: 11019 - protein, 16 aa, Mus sp.
EEAGAYDGPRTADGIV

SEQ ID NO: 11020 - protein, 15 aa, Mus sp.
ITPDIIINPHAIPSR

SEQ ID NO: 11021 - protein, 17 aa, Mus sp.
APNLHFHNPNPEIPALL

SEQ ID NO: 11022 - protein, 14 aa, Mus sp.
STDYGNFLANEASP

SEQ ID NO: 11023 - protein, 17 aa, Mus sp.
DIRSDWTNPEINKAVLH

SEQ ID NO: 11024 - protein, 20 aa, Mus sp.
DGHGGYKPFQNPVPNQSPSS

SEQ ID NO: 11025 - protein, 15 aa, Mus sp.
VPPVFTQPTANIMPS

SEQ ID NO: 11026 - protein, 19 aa, Mus sp.
APAAAATTAAPAAAAAPAK

SEQ ID NO: 11027 - protein, 13 aa, Mus sp.
LPDFHVPEITIPE

SEQ ID NO: 11028 - protein, 17 aa, Mus sp.
KAVDVFFPPEAQNDFPV

SEQ ID NO: 11029 - protein, 16 aa, Mus sp.
YLLSQSSPAPLTAAEE

SEQ ID NO: 11030 - protein, 16 aa, Mus sp.
FSPYAAPSPQGSYQPS

SEQ ID NO: 11031 - protein, 17 aa, Mus sp.
GHPGIIPPHATLVFDVE

SEQ ID NO: 11032 - protein, 18 aa, Mus sp.
RSLQAFSNPSAGISVDVK

SEQ ID NO: 11033 - protein, 15 aa, Mus sp.
YENVQVSPVPGGPPG

SEQ ID NO: 11034 - protein, 17 aa, Mus sp.
EDPDGFSWPATLPSVYK

SEQ ID NO: 11035 - protein, 9 aa, Mus sp.
LIMVMMEDY

SEQ ID NO: 11036 - protein, 25 aa, Mus sp.
DAGTIAGLNVMRIINEPTAAAIAYG

SEQ ID NO: 11037 - protein, 18 aa, Mus sp.
AGHFRSPHTTEVVGGAPQ

SEQ ID NO: 11038 - protein, 17 aa, Mus sp.
DEAQVEFMASHGNEAAR

SEQ ID NO: 11039 - protein, 10 aa, Mus sp.
FVAPAVTPVK

SEQ ID NO: 11040 - protein, 18 aa, Mus sp.
TRELWDSPEPASAPRTPQ

SEQ ID NO: 11041 - protein, 17 aa, Mus sp.
DSKQYYQQPTATAAAVA

SEQ ID NO: 11042 - protein, 14 aa, Mus sp.
IEVWERPLSNLAWA

SEQ ID NO: 11043 - protein, 10 aa, BOVIN
VVPPFLQPEV

SEQ ID NO: 11044 - protein, 8 aa, BOVIN
VYPFPGPI

SEQ ID NO: 11045 - protein, 17 aa, BOVIN
YQEPVLGPVRGPFPIIV

SEQ ID NO: 11046 - protein, 18 aa, Listeria monocytogenes
DDTTVKFTLPTVAPAFEN

SEQ ID NO: 11047 - protein, 16 aa, Listeria monocytogenes
GTKEKVVATPVSNVST

SEQ ID NO: 11048 - protein, 22 aa, Listeria monocytogenes
APGAELIYGHKAASREEFATWA

SEQ ID NO: 11049 - protein, 15 aa, Mus sp.
SMFLHINETYLLMEQ

SEQ ID NO: 11050 - protein, 13 aa, Mus sp.
TTDYNSPEAGNIF

SEQ ID NO: 11051 - protein, 16 aa, Mus sp.
FGTGHSAPSASPAFGA

SEQ ID NO: 11052 - protein, 18 aa, Mus sp.
TWSDAAAPFAGLSTDQTL

SEQ ID NO: 11053 - protein, 15 aa, Mus sp.
AEQEVLAPQVVLSLG

SEQ ID NO: 11054 - protein, 17 aa, Mus sp.
NQLEALVGPEANVGPYG

SEQ ID NO: 11055 - protein, 11 aa, Mus sp.
VLAPQVVLSLG

SEQ ID NO: 11056 - protein, 14 aa, Mus sp.
REGSYEAAKILLDH

SEQ ID NO: 11057 - protein, 19 aa, Mus sp.
EPPPAYEPPAPAPAPLPPP

SEQ ID NO: 11058 - protein, 20 aa, Mus sp.
REPPPAYEPPAPAPAPLPPP

SEQ ID NO: 11059 - protein, 29 aa, Mus sp.
GGLDSLIGDSNFGAPSASVAAAPAPARLG

SEQ ID NO: 11060 - protein, 17 aa, Mus sp.
IGDSNFGAPSASVAAAP

SEQ ID NO: 11061 - protein, 18 aa, Mus sp.
IGDSNFGAPSASVAAAPA

SEQ ID NO: 11062 - protein, 20 aa, Mus sp.
DPTPDPNTAYASYPSASVEN

SEQ ID NO: 11063 - protein, 19 aa, Mus sp.
TPDPNTAYASYPSASVENY

SEQ ID NO: 11064 - protein, 23 aa, Mus sp.
TPDPNTAYASYPSASVENYQQPP

SEQ ID NO: 11065 - protein, 14 aa, Mus sp.
ISSVTVFYLGQHAM

SEQ ID NO: 11066 - protein, 14 aa, Mus sp.
ESKVVVPPLPGKAF

SEQ ID NO: 11067 - protein, 15 aa, Mus sp.
EQIYYAGPVNNPGLD

SEQ ID NO: 11068 - protein, 21 aa, Mus sp.
RKGEQIYYAGPVNNPGLDVPQ

SEQ ID NO: 11069 - protein, 16 aa, Mus sp.
GIDPYDQPNAIYIERH

SEQ ID NO: 11070 - protein, 19 aa, Mus sp.
EPPPPRSHYSNIEANESEE

SEQ ID NO: 11071 - protein, 21 aa, Mus sp.
EPPPPRSHYSNIEANESEEVR

SEQ ID NO: 11072 - protein, 14 aa, Mus sp.
DLSQHATPLPTPAV

SEQ ID NO: 11073 - protein, 17 aa, Mus sp.
GDLSQHATPLPTPAVLP

SEQ ID NO: 11074 - protein, 18 aa, Mus sp.
GPHSMRYFETAVSRPGLE

SEQ ID NO: 11075 - protein, 18 aa, Mus sp.
DFLKKWETPSQNTAQLDQ

SEQ ID NO: 11076 - protein, 15 aa, Mus sp.
GSLFLKTPKIVSSKD

SEQ ID NO: 11077 - protein, 16 aa, Mus sp.
GSLFLKTPKIVSSKDY

SEQ ID NO: 11078 - protein, 19 aa, Mus sp.
LQHGSLFLKTPKIVSSKDY

SEQ ID NO: 11079 - protein, 16 aa, Mus sp.
RPYLNWNGPPASLEEA

SEQ ID NO: 11080 - protein, 21 aa, Mus sp.
LPEEVGEYRQPSGGSVPVSPG

SEQ ID NO: 11081 - protein, 17 aa, Mus sp.
ASVATNPIITPVAQENQ

SEQ ID NO: 11082 - protein, 21 aa, Mus sp.
EKIQASVATNPIITPVAQENQ

SEQ ID NO: 11083 - protein, 16 aa, Mus sp.
ELEEQLGPVAEETRAR

SEQ ID NO: 11084 - protein, 15 aa, Mus sp.
KELEEQLGPVAEETR

SEQ ID NO: 11085 - protein, 12 aa, Mus sp.
TNPIITPVAQEN

SEQ ID NO: 11086 - protein, 13 aa, Mus sp.
TNPIITPVAQENQ

SEQ ID NO: 11087 - protein, 15 aa, Mus sp.
VATNPIITPVAQENQ

SEQ ID NO: 11088 - protein, 20 aa, Mus sp.
SPTSPNYTPTSPNYSPTSPS

SEQ ID NO: 11089 - protein, 17 aa, Mus sp.
TPQSPTYTPSSPSYSPS

SEQ ID NO: 11090 - protein, 13 aa, Mus sp.
LPVKWMAPESIFD

SEQ ID NO: 11091 - protein, 14 aa, Mus sp.
VKDGYQMAQPVFAP

SEQ ID NO: 11092 - protein, 17 aa, Mus sp.
FKQETLPSNSNESHDHM

SEQ ID NO: 11093 - protein, 15 aa, Mus sp.
HPIQWNAPEPSHITK

SEQ ID NO: 11094 - protein, 14 aa, Mus sp.
IKIAWESPQGQVSR

SEQ ID NO: 11095 - protein, 15 aa, Mus sp.
LLLHWQPPLSHNGVL

SEQ ID NO: 11096 - protein, 15 aa, Mus sp.
KRSNEFDYPSVGQLA

SEQ ID NO: 11097 - protein, 14 aa, Mus sp.
RSNEFDYPSVGQLA

SEQ ID NO: 11098 - protein, 16 aa, Mus sp.
LANMISEPRISYGNDA

SEQ ID NO: 11099 - protein, 16 aa, Mus sp.
VKVIYKAPSENWAMEG

SEQ ID NO: 11100 - protein, 28 aa, Mus sp.
EDDIEADHVGTYGISVYQSPGDIGQYTF

SEQ ID NO: 11101 - protein, 19 aa, Mus sp.
YVDLDKKETVWMLPEFGQL

SEQ ID NO: 11102 - protein, 13 aa, Mus sp.
AEYWNSQPEILER

SEQ ID NO: 11103 - protein, 15 aa, Mus sp.
RPDAEYWNSQPEILE

SEQ ID NO: 11104 - protein, 15 aa, Mus sp.
STQLIRNGDWTFQVL

SEQ ID NO: 11105 - protein, 18 aa, Mus sp.
APAAAATTAAPAAAAAPA

SEQ ID NO: 11106 - protein, 19 aa, Mus sp.
DLYTAKGLFRAAVPSGAST

SEQ ID NO: 11107 - protein, 15 aa, Mus sp.
KKAGYITPVPGGVGP

SEQ ID NO: 11108 - protein, 15 aa, Mus sp.
SNLSYREPDPEDAVG

SEQ ID NO: 11109 - protein, 18 aa, Mus sp.
LNVMRIINEPTAAAIAYG

SEQ ID NO: 11110 - protein, 15 aa, Mus sp.
SNLLLQSPGVLTAAR

SEQ ID NO: 11111 - protein, 15 aa, Mus sp.
EEDTEYMTPTSRPVG

SEQ ID NO: 11112 - protein, 15 aa, Mus sp.
VPWNFHEPQPGQYEF

SEQ ID NO: 11113 - protein, 11 aa, Mus sp.
ERFPDENFKLK

SEQ ID NO: 11114 - protein, 19 aa, Mus sp.
IQGGDFTRGDGTGGKSIYG

SEQ ID NO: 11115 - protein, 10 aa, Mus sp.
VEKPFAIAKE

SEQ ID NO: 11116 - protein, 23 aa, Mus sp.
GPPGFEDYVELPPSVSQAATSPP

SEQ ID NO: 11117 - protein, 23 aa, Mus sp.
PPGFEDYVELPPSVSQAATSPPG

SEQ ID NO: 11118 - protein, 19 aa, Mus sp.
EDYVELPPSVSQAAKSPPG

SEQ ID NO: 11119 - protein, 14 aa, Mus sp.
NLRDNYRFAHTNIE

SEQ ID NO: 11120 - protein, 12 aa, Mus sp.
EDRRYNPPIIHQ

SEQ ID NO: 11121 - protein, 13 aa, Mus sp.
EDRRYNPPIIHQG

SEQ ID NO: 11122 - protein, 14 aa, Mus sp.
EDRRYNPPIIHQGF

SEQ ID NO: 11123 - protein, 15 aa, Mus sp.
EDRRYNPPIIHQGFQ

SEQ ID NO: 11124 - protein, 13 aa, Mus sp.
EKEDRRYNPPIIH

SEQ ID NO: 11125 - protein, 20 aa, Mus sp.
EKEDRRYNPPIIHQGFQDTS

SEQ ID NO: 11126 - protein, 18 aa, Mus sp.
HGLELEEPPLVLAAANVV

SEQ ID NO: 11127 - protein, 14 aa, Mus sp.
LELEEPPLVLAAAN

SEQ ID NO: 11128 - protein, 17 aa, Mus sp.
KPGSDTIKPDVNKSKEY

SEQ ID NO: 11129 - protein, 18 aa, Mus sp.
FHQRFESPDSQASAEQPE

SEQ ID NO: 11130 - protein, 17 aa, Mus sp.
DGNHTLFHNPHVNPLPT

SEQ ID NO: 11131 - protein, 15 aa, Mus sp.
GNHTLFHNPHVNPLP

SEQ ID NO: 11132 - protein, 14 aa, Mus sp.
NHTLFHNPHVNPLP

SEQ ID NO: 11133 - protein, 15 aa, Mus sp.
NHTLFHNPHVNPLPT

SEQ ID NO: 11134 - protein, 14 aa, Mus sp.
SPAEYAGPEGSYFG

SEQ ID NO: 11135 - protein, 18 aa, Mus sp.
DEATRYLAPTILTDVDPN

SEQ ID NO: 11136 - protein, 11 aa, Mus sp.
DGDSYRSPWSN

SEQ ID NO: 11137 - protein, 13 aa, Mus sp.
GDSYRSPWSNKYD

SEQ ID NO: 11138 - protein, 16 aa, Mus sp.
GDSYRSPWSNKYDPPL

SEQ ID NO: 11139 - protein, 12 aa, Mus sp.
GKKFTAPHILIA

SEQ ID NO: 11140 - protein, 17 aa, Mus sp.
DRSAWYMGPVTRQEAQT

SEQ ID NO: 11141 - protein, 17 aa, Mus sp.
NNQDFRGSAGAPSVENV

SEQ ID NO: 11142 - protein, 17 aa, Mus sp.
NHIEVWERPLSNLAWAV

SEQ ID NO: 11143 - protein, 16 aa, Mus sp.
SFFWNVAPGAESAVAS

SEQ ID NO: 11144 - protein, 17 aa, Mus sp.
ARMAPYQGPDAAPGALD

SEQ ID NO: 11145 - protein, 14 aa, Mus sp.
GERFEAPEALFQPH

SEQ ID NO: 11146 - protein, 17 aa, Mus sp.
ITKQEYDEAGPSIVHRK

SEQ ID NO: 11147 - protein, 11 aa, Mus sp.
FVAPAVTPVKG

SEQ ID NO: 11148 - protein, 17 aa, Mus sp.
RPALAYESVVAQEGNPI

SEQ ID NO: 11149 - protein, 15 aa, Mus sp.
ESEEEYSAPLPTPAP

SEQ ID NO: 11150 - protein, 13 aa, Mus sp.
GVDFIGSTVGLAK

SEQ ID NO: 11151 - protein, 14 aa, Mus sp.
TSSYSNPTIGYENR

SEQ ID NO: 11152 - protein, 17 aa, Mus sp.
FVLPANAFASPLQNPDN

SEQ ID NO: 11153 - protein, 14 aa, Mus sp.
GIPVYRFVLPANAF

SEQ ID NO: 11154 - protein, 18 aa, Mus sp.
GTTVYRQFWIFDVQNPDD

SEQ ID NO: 11155 - protein, 17 aa, Mus sp.
DLVDAVTPSPQPSKEED

SEQ ID NO: 11156 - protein, 16 aa, Mus sp.
LDAYPVENQGLKLGFN

SEQ ID NO: 11157 - protein, 15 aa, Mus sp.
DTRFVAPGALGNAPW

SEQ ID NO: 11158 - protein, 15 aa, Mus sp.
SRGEYSWAVAQGVKQ

SEQ ID NO: 11159 - protein, 28 aa, Mus sp.
EKWEETELDQLFSGPLPGRLPVNHRPFS

SEQ ID NO: 11160 - protein, 16 aa, Mus sp.
ELDQLFSGPLPGRLPV

SEQ ID NO: 11161 - protein, 17 aa, Mus sp.
RRTDWEAPTGQPSAPGP

SEQ ID NO: 11162 - protein, 15 aa, Mus sp.
RTDWEAPTGQPSAPG

SEQ ID NO: 11163 - protein, 18 aa, Mus sp.
RPGLSYHYAHSHLAEEEG

SEQ ID NO: 11164 - protein, 16 aa, Mus sp.
ASFKDPKISTSLPVLD

SEQ ID NO: 11165 - protein, 16 aa, Mus sp.
QPPTGYSTPTAPQAYS

SEQ ID NO: 11166 - protein, 17 aa, Mus sp.
GPRPEEYEFLTPVEEAP

SEQ ID NO: 11167 - protein, 15 aa, Mus sp.
ARQNFTEPTAIQAQG

SEQ ID NO: 11168 - protein, 17 aa, Mus sp.
ARQNFTEPTAIQAQGWP

SEQ ID NO: 11169 - protein, 16 aa, Mus sp.
LNVLRIINEPTAAAIA

SEQ ID NO: 11170 - protein, 15 aa, Mus sp.
YHFVTPLTSMVVTKP

SEQ ID NO: 11171 - protein, 12 aa, Mus sp.
RYMAPEVLESRM

SEQ ID NO: 11172 - protein, 19 aa, Mus sp.
VGEVKDYEPPFGSKVREHP

SEQ ID NO: 11173 - protein, 19 aa, Mus sp.
LTGMAFRVPTPNVSVVDLT

SEQ ID NO: 11174 - protein, 14 aa, Mus sp.
MAFRVPTPNVSVVD

SEQ ID NO: 11175 - protein, 11 aa, Mus sp.
RVPTPNVSVVD

SEQ ID NO: 11176 - protein, 17 aa, Mus sp.
TPTDVTHHPIPSEEDIN

SEQ ID NO: 11177 - protein, 13 aa, Mus sp.
RYMAPEVLDDSIN

SEQ ID NO: 11178 - protein, 18 aa, Mus sp.
GGGDPEAPAPAPAAERPP

SEQ ID NO: 11179 - protein, 20 aa, Mus sp.
HPPQEATNSPKPQPSYEELE

SEQ ID NO: 11180 - protein, 16 aa, Mus sp.
DPIQKYLTPQMATSIT

SEQ ID NO: 11181 - protein, 19 aa, Mus sp.
SPVSETVVTPEAAPEKNPV

SEQ ID NO: 11182 - protein, 16 aa, Mus sp.
AIETIVAAMSNLVPPV

SEQ ID NO: 11183 - protein, 20 aa, Mus sp.
KNPTDEYLDAMMNEAPGPIN

SEQ ID NO: 11184 - protein, 15 aa, Mus sp.
SVASQFQMHSTPVRI

SEQ ID NO: 11185 - protein, 16 aa, Mus sp.
LPETFRRPQIDPAVEG

SEQ ID NO: 11186 - protein, 16 aa, Mus sp.
RSQVTPSVPSEALDDS

SEQ ID NO: 11187 - protein, 25 aa, Mus sp.
TPARAPETRSQVTPSVPSEALDDST

SEQ ID NO: 11188 - protein, 16 aa, Mus sp.
HNKLYVLQWLTLFFDN

SEQ ID NO: 11189 - protein, 18 aa, Mus sp.
DEGERYIAPTVLVDVQET

SEQ ID NO: 11190 - protein, 18 aa, Mus sp.
APLNVQFSSPLPGEAVKD

SEQ ID NO: 11191 - protein, 16 aa, Mus sp.
TRPHWLEPTIYSSEED

SEQ ID NO: 11192 - protein, 15 aa, Mus sp.
FVNYSNAVTLHLGNN

SEQ ID NO: 11193 - protein, 16 aa, Mus sp.
VPIYEGYALPHAILRL

SEQ ID NO: 11194 - protein, 18 aa, Mus sp.
RQPAWRDPLSPFAVGGDD

SEQ ID NO: 11195 - protein, 15 aa, Mus sp.
REVSSVEAPSVSPAR

SEQ ID NO: 11196 - protein, 17 aa, Mus sp.
GSTLWSSPLPEEAQDVT

SEQ ID NO: 11197 - protein, 18 aa, Mus sp.
VPAQSTFWRPQTQEERPH

SEQ ID NO: 11198 - protein, 16 aa, Mus sp.
RATTYIDPRTGKSALD

SEQ ID NO: 11199 - protein, 16 aa, Mus sp.
GGLPDYSAPNPIKVTH

SEQ ID NO: 11200 - protein, 17 aa, Mus sp.
GGLPDYSAPNPIKVTHR

SEQ ID NO: 11201 - protein, 14 aa, Mus sp.
LPDYSAPNPIKVTH

SEQ ID NO: 11202 - protein, 14 aa, Mus sp.
EALFYNHALPLPGF

SEQ ID NO: 11203 - protein, 23 aa, Mus sp.
DESGFPKPPSYNVATTLPSYDEA

SEQ ID NO: 11204 - protein, 14 aa, Mus sp.
GVYASPSIAGSRPG

SEQ ID NO: 11205 - protein, 16 aa, Mus sp.
SESSVSTPSASFEPDV

SEQ ID NO: 11206 - protein, 20 aa, Mus sp.
KPTVTVVSPLPNDSINPQPS

SEQ ID NO: 11207 - protein, 23 aa, Mus sp.
GIKADKADKAAASGPASASAPAA

SEQ ID NO: 11208 - protein, 15 aa, Mus sp.
RKIVYEGPELNHAFG

SEQ ID NO: 11209 - protein, 17 aa, Mus sp.
KWKALYTDPKSSETAAF

SEQ ID NO: 11210 - protein, 15 aa, Mus sp.
ERASFITPVPGGVGP

SEQ ID NO: 11211 - protein, 16 aa, Mus sp.
KPEDYQGGRTGEAIVD

SEQ ID NO: 11212 - protein, 16 aa, Mus sp.
VPTVPLLPPQVNQSLA

SEQ ID NO: 11213 - protein, 20 aa, Mus sp.
VPTVPLLPPQVNQSLASMPP

SEQ ID NO: 11214 - protein, 16 aa, Mus sp.
EPYAHAAPESIPATFE

SEQ ID NO: 11215 - protein, 16 aa, Mus sp.
GPGAVEGPNPASSPDA

SEQ ID NO: 11216 - protein, 20 aa, Mus sp.
SPPSTPDSASAPSTTPASPA

SEQ ID NO: 11217 - protein, 17 aa, Mus sp.
RPVQFPYVTPAPHEPVK

SEQ ID NO: 11218 - protein, 9 aa, Mus sp.
VILLPKDIE

SEQ ID NO: 11219 - protein, 13 aa, Mus sp.
APDMVYLGSMTNF

SEQ ID NO: 11220 - protein, 15 aa, Mus sp.
FDQGYEAPGVREAAA

SEQ ID NO: 11221 - protein, 14 aa, Mus sp.
VVIEVFTPVVQRIL

SEQ ID NO: 11222 - protein, 17 aa, Mus sp.
YDPDFLRTAVAQVIGDR

SEQ ID NO: 11223 - protein, 15 aa, Mus sp.
AGNAFKKADPQEAIN

SEQ ID NO: 11224 - protein, 18 aa, Mus sp.
VPYPFQWGMPTVSAAGVI

SEQ ID NO: 11225 - protein, 22 aa, Mus sp.
VPPGLEFLVQIDQILIHQKAER

SEQ ID NO: 11226 - protein, 24 aa, Mus sp.
GPDGKGMNPPSYYTQPVPVPNANA

SEQ ID NO: 11227 - protein, 25 aa, Mus sp.
TGPDGKGMNPPSYYTQPVPVPNANA

SEQ ID NO: 11228 - protein, 12 aa, Mus sp.
DHVDFSQPEPHT

SEQ ID NO: 11229 - protein, 17 aa, Mus sp.
TVLEMYKVHNPVPLIVG

SEQ ID NO: 11230 - protein, 19 aa, Mus sp.
SPRDDARVYHDPSTQEPVT

SEQ ID NO: 11231 - protein, 16 aa, Mus sp.
RFTYQNAAAQPETGPG

SEQ ID NO: 11232 - protein, 16 aa, Mus sp.
LSRFTSGVPSFVLDTE

SEQ ID NO: 11233 - protein, 14 aa, Mus sp.
RGTSYQSPHGIPID

SEQ ID NO: 11234 - protein, 18 aa, Mus sp.
NNAYYLDKMHYSIEGKDT

SEQ ID NO: 11235 - protein, 19 aa, Mus sp.
RASLEDFYGSPIPSVSLKL

SEQ ID NO: 11236 - protein, 14 aa, Mus sp.
VRVSYYGPKTSPVQ

SEQ ID NO: 11237 - protein, 20 aa, Listeria monocytogenes
ADFRYVFDTAKATAASSYPG

SEQ ID NO: 11238 - protein, 17 aa, Listeria monocytogenes
YPGSDETPPVVNPGETN

SEQ ID NO: 11239 - protein, 15 aa, Mus sp.
SGKIEVEKPFAIAKE

SEQ ID NO: 11240 - protein, 9 aa, Mus sp.
FLLFPDMDA

SEQ ID NO: 11241 - protein, 20 aa, Mus sp.
TEDGDMRLVNGASANEGRVE

SEQ ID NO: 11242 - protein, 14 aa, Mus sp.
FYVDLDKKETVWML

SEQ ID NO: 11243 - protein, 13 aa, Listeria monocytogenes
WNEKYAQAYPNVS

SEQ ID NO: 11244 - protein, 6 aa, Mus sp.
LVEKIF

SEQ ID NO: 11245 - protein, 19 aa, Mus sp.
IQGGDFTRGDGTGGKSIYG

SEQ ID NO: 11246 - protein, 16 aa, Mus sp.
GSLGEYLFERLTLKHD

SEQ ID NO: 11247 - protein, 25 aa, Listeria monocytogenes
DFRYVFDTAKATAASSYPGSDETPP

SEQ ID NO: 11248 - protein, 20 aa, Mus sp.
DLYKSFVQNYPVVSIEDPFD

SEQ ID NO: 11249 - protein, 13 aa, Mus sp.
QLIRNGDWTFQVL

SEQ ID NO: 11250 - protein, 17 aa, Mus sp.
WKPGSDTIKPDVNKSKE

SEQ ID NO: 11251 - protein, 16 aa, Listeria monocytogenes
WNEKYAQAYPNVSAKI

SEQ ID NO: 11252 - protein, 20 aa, Listeria monocytogenes
VDDTTVKFTLPTVAPAFENT

SEQ ID NO: 11253 - protein, 14 aa, Mus sp.
IETIVAAMSNLVPP

SEQ ID NO: 11254 - protein, 14 aa, Mus sp.
AFSNPSAGISVDVK

SEQ ID NO: 11255 - protein, 14 aa, Mus sp.
FEYAEAPSRLSPDD

SEQ ID NO: 11256 - protein, 16 aa, Mus sp.
VELPPSVSQAAKSPPG

SEQ ID NO: 11257 - protein, 25 aa, Mus sp.
NVDPFKAVDTNRASMGQASPESKGF

SEQ ID NO: 11258 - protein, 16 aa, Mus sp.
DRKIVYEGPELNHAFG

SEQ ID NO: 11259 - protein, 15 aa, Mus sp.
YVTQFHPPHIEIQML

SEQ ID NO: 11260 - protein, 20 aa, Mus sp.
SGPKPFSAPKPQTSPSPKPA

SEQ ID NO: 11261 - protein, 11 aa, Mus sp.
ERFPDENFKLK

SEQ ID NO: 11262 - protein, 19 aa, Listeria monocytogenes
GTKEKVVATPVSNVSTSSA

SEQ ID NO: 11263 - protein, 16 aa, Mus sp.
YDMNAANVGWNGSTFA

SEQ ID NO: 11264 - protein, 12 aa, Mus sp.
QPNVVISLSRTE

SEQ ID NO: 11265 - protein, 17 aa, Mus sp.
LGFPYEGPAPLEAIANG

SEQ ID NO: 11266 - protein, 15 aa, Mus sp.
SSIYYISSTIAYAVG

SEQ ID NO: 11267 - protein, 17 aa, Mus sp.
GPNFEYAEAPSRLSPDD

SEQ ID NO: 11268 - protein, 18 aa, Mus sp.
YVPPPFAAAAINEAIDAE

SEQ ID NO: 11269 - protein, 18 aa, Mus sp.
VDFVAWATGEPNFANDDE

SEQ ID NO: 11270 - protein, 15 aa, Mus sp.
ELEEQLGPVAEETRA

SEQ ID NO: 11271 - protein, 14 aa, Mus sp.
IPDYWDPAALPDLG

SEQ ID NO: 11272 - protein, 16 aa, Mus sp.
EAGAYDGPRTADGIVS

SEQ ID NO: 11273 - protein, 19 aa, Listeria monocytogenes
DDTTVKFTLPTVAPAFENT

SEQ ID NO: 11274 - protein, 14 aa, Mus sp.
ISALEYGMPVTLIG

SEQ ID NO: 11275 - protein, 23 aa, Mus sp.
EIDLKGIPVYRFVLPANAFASPL

SEQ ID NO: 11276 - protein, 14 aa, Mus sp.
FQINQDEEEEEDED

SEQ ID NO: 11277 - protein, 25 aa, Mus sp.
GAGIIDVIKSGYKIPELSQSLDYIQ

SEQ ID NO: 11278 - protein, 15 aa, Listeria monocytogenes
YPGSDETPPVVNPGE

SEQ ID NO: 11279 - protein, 17 aa, Mus sp.
GPPPYHESLAGASQPPY

SEQ ID NO: 11280 - protein, 16 aa, Mus sp.
APVEGASPTSISAVDG

SEQ ID NO: 11281 - protein, 25 aa, Mus sp.
LPGVPPGLEFLVQIDQILIHQKAER

SEQ ID NO: 11282 - protein, 21 aa, Listeria monocytogenes
AVDDTTVKFTLPTVAPAFENT

SEQ ID NO: 11283 - protein, 17 aa, Mus sp.
DGDSYRSPWSNKYDPPL

SEQ ID NO: 11284 - protein, 21 aa, Mus sp.
SDPSKTGIGAPTISTGPPGKY

SEQ ID NO: 11285 - protein, 12 aa, Mus sp.
WTISPVPQSIVD

SEQ ID NO: 11286 - protein, 10 aa, Mus sp.
VEKPFAIAKE

SEQ ID NO: 11287 - protein, 15 aa, Mus sp.
EAGAYDGPRTADGIV

SEQ ID NO: 11288 - protein, 16 aa, Listeria monocytogenes
DGLTWHDGKPLTADDV

SEQ ID NO: 11289 - protein, 9 aa, Mus sp.
SPITVEWRA

SEQ ID NO: 11290 - protein, 16 aa, Mus sp.
GLELEEPPLVLAAANV

SEQ ID NO: 11291 - protein, 16 aa, Listeria monocytogenes
GTKEKVVATPVSNVST

SEQ ID NO: 11292 - protein, 21 aa, Mus sp.
NGNPLNSVFVAPAVTPVKGVL

SEQ ID NO: 11293 - protein, 19 aa, Mus sp.
YVDLDKKETVWMLPEFGQL

SEQ ID NO: 11294 - protein, 22 aa, Mus sp.
IDLKGIPVYRFVLPANAFASPL

SEQ ID NO: 11295 - protein, 18 aa, Mus sp.
GPNFEYAEAPSRLSPDDA

SEQ ID NO: 11296 - protein, 25 aa, Mus sp.
GSEIDLKGIPVYRFVLPANAFASPL

SEQ ID NO: 11297 - protein, 13 aa, Mus sp.
LPQDPTFHTPLDL

SEQ ID NO: 11298 - protein, 16 aa, Mus sp.
IGNERFRCPEAIFQPS

SEQ ID NO: 11299 - protein, 18 aa, Listeria monocytogenes
EAKELVDNAPKALKEGIA

SEQ ID NO: 11300 - protein, 14 aa, Mus sp.
ELEEQLGPVAEETR

SEQ ID NO: 11301 - protein, 16 aa, Mus sp.
IMFETFNTPAMYVAIQ

SEQ ID NO: 11302 - protein, 9 aa, Mus sp.
FVLPANAFA

SEQ ID NO: 11303 - protein, 20 aa, Mus sp.
DPTPDPNTAYASYPSASVEN

SEQ ID NO: 11304 - protein, 29 aa, Mus sp.
NVDPFKAVDTNRASMGQASPESKGFTDLL

SEQ ID NO: 11305 - protein, 12 aa, Mus sp.
STQLIRNGDWTF

SEQ ID NO: 11306 - protein, 17 aa, BOVIN
PPVASVVVGPSVVAVPL

SEQ ID NO: 11307 - protein, 9 aa, Mus sp.
LDFGSLSNL

SEQ ID NO: 11308 - protein, 17 aa, Mus sp.
VDFVAWATGEPNFANDD

SEQ ID NO: 11309 - protein, 16 aa, Mus sp.
EAPQATVFPKSPVLLG

SEQ ID NO: 11310 - protein, 16 aa, Mus sp.
RFTYQNAAAQPETGPG

SEQ ID NO: 11311 - protein, 13 aa, Mus sp.
IYEGYALPHAILR

SEQ ID NO: 11312 - protein, 15 aa, Mus sp.
IGDESVGRVVFGLFG

SEQ ID NO: 11313 - protein, 16 aa, Mus sp.
EAIETIVAAMSNLVPP

SEQ ID NO: 11314 - protein, 18 aa, Mus sp.
NRDGDSYRSPWSNKYDPP

SEQ ID NO: 11315 - protein, 25 aa, Mus sp.
KKHVPEEVLAVLEQEPIVLPAWDPM

SEQ ID NO: 11316 - protein, 19 aa, Mus sp.
SPESPDQWSSSSPHSASDW

SEQ ID NO: 11317 - protein, 18 aa, Mus sp.
AAPHIYQNSFVQVVLNSL

SEQ ID NO: 11318 - protein, 23 aa, Listeria monocytogenes
RYVFDTAKATAASSYPGSDETPP

SEQ ID NO: 11319 - protein, 17 aa, Mus sp.
SPTSPSYSPTSPSYSPT

SEQ ID NO: 11320 - protein, 20 aa, Mus sp.
DLPKNWDWRNVNGVNYASVT

SEQ ID NO: 11321 - protein, 16 aa, Mus sp.
WKPGSDTIKPDVNKSK

SEQ ID NO: 11322 - protein, 21 aa, Mus sp.
DVIIVDSGKIEVEKPFAIAKE

SEQ ID NO: 11323 - protein, 19 aa, Mus sp.
TPAYTIPFYTPIPNGLYPS

SEQ ID NO: 11324 - protein, 17 aa, Mus sp.
LEFIDVHVKLPRFKIEE

SEQ ID NO: 11325 - protein, 16 aa, Mus sp.
LFPQYTAPSILPSDIT

SEQ ID NO: 11326 - protein, 17 aa, Mus sp.
KGADKTVKGPDGLTALE

SEQ ID NO: 11327 - protein, 24 aa, Mus sp.
LYCGGAEDPDVTASAERRLHKSPG

SEQ ID NO: 11328 - protein, 19 aa, Mus sp.
GKLLEAKGPVTDVAYSHDG

SEQ ID NO: 11329 - protein, 16 aa, Mus sp.
EDYVELPPSVSQAATS

SEQ ID NO: 11330 - protein, 16 aa, Mus sp.
AAELQTLAPAINWLPF

SEQ ID NO: 11331 - protein, 23 aa, Mus sp.
EPGLFEWTKWVAGSTLPAWIPPS

SEQ ID NO: 11332 - protein, 17 aa, Mus sp.
MPEMNIKAPKISMPDID

SEQ ID NO: 11333 - protein, 19 aa, Mus sp.
GPKPFSAPKPQTSPSPKPA

SEQ ID NO: 11334 - protein, 11 aa, Mus sp.
DGDSYRSPWSN

SEQ ID NO: 11335 - protein, 15 aa, Mus sp.
SVASQFQMHSTPVRI

SEQ ID NO: 11336 - protein, 15 aa, Mus sp.
ITPSYVAFTPEGERL

SEQ ID NO: 11337 - protein, 20 aa, Mus sp.
YPTPAYTIPFYTPIPNGLYP

SEQ ID NO: 11338 - protein, 23 aa, Mus sp.
ASFDPQGGLQNIAVVKHNLGVLT

SEQ ID NO: 11339 - protein, 17 aa, Mus sp.
ISALEYGMPVTLIGEAV

SEQ ID NO: 11340 - protein, 10 aa, Mus sp.
DPKISTSLPV

SEQ ID NO: 11341 - protein, 17 aa, Mus sp.
VPPPFAAAAINEAIDAE

SEQ ID NO: 11342 - protein, 16 aa, Mus sp.
EDYVELPPSVSQAAKS

SEQ ID NO: 11343 - protein, 21 aa, BOVIN
AGPPVASVVVGPSVVAVPLPL

SEQ ID NO: 11344 - protein, 15 aa, Mus sp.
VPIYEGYALPHAILR

SEQ ID NO: 11345 - protein, 15 aa, Mus sp.
QSPYINPIIPFTGPI

SEQ ID NO: 11346 - protein, 16 aa, Mus sp.
AEVEFSAPYPMEVIFE

SEQ ID NO: 11347 - protein, 14 aa, Mus sp.
GTPDYIAPEILQGL

SEQ ID NO: 11348 - protein, 12 aa, Mus sp.
NWSLPNRAVEPQ

SEQ ID NO: 11349 - protein, 15 aa, Mus sp.
KLLEAKGPVTDVAYS

SEQ ID NO: 11350 - protein, 16 aa, Mus sp.
AEIEYAMAYSKAAFER

SEQ ID NO: 11351 - protein, 13 aa, Mus sp.
FGNIYSTPLALQM

SEQ ID NO: 11352 - protein, 15 aa, Mus sp.
AEVEFSAPYPMEVIF

SEQ ID NO: 11353 - protein, 11 aa, Mus sp.
EDRRYNPPIIH

SEQ ID NO: 11354 - protein, 13 aa, Mus sp.
LVFDVTAPNTFKT

SEQ ID NO: 11355 - protein, 13 aa, Mus sp.
IQEPYTFPAILKS

SEQ ID NO: 11356 - protein, 24 aa, Mus sp.
SEIDLKGIPVYRFVLPANAFASPL

SEQ ID NO: 11357 - protein, 18 aa, Mus sp.
KKELEEQLGPVAEETRAR

SEQ ID NO: 11358 - protein, 12 aa, Mus sp.
TSWLDGKHVVFG

SEQ ID NO: 11359 - protein, 21 aa, Mus sp.
IDLKGIPVYRFVLPANAFASP

SEQ ID NO: 11360 - protein, 16 aa, Mus sp.
SALVWLSPSVLVSGAE

SEQ ID NO: 11361 - protein, 15 aa, Mus sp.
EVDRYDAPGIAFYPG

SEQ ID NO: 11362 - protein, 20 aa, Mus sp.
SEPTTLFKTASALRSSAPLN

SEQ ID NO: 11363 - protein, 11 aa, Mus sp.
GAWTGPMGNWA

SEQ ID NO: 11364 - protein, 15 aa, Mus sp.
SFVQNYPVVSIEDPF

SEQ ID NO: 11365 - protein, 23 aa, Mus sp.
LPDLTNIHFPSPLPTPLDPEEPP

SEQ ID NO: 11366 - protein, 18 aa, Mus sp.
MLDENNHLIQCIMDYQNK

SEQ ID NO: 11367 - protein, 15 aa, Mus sp.
VELPPSVSQAATSPP

SEQ ID NO: 11368 - protein, 18 aa, Listeria monocytogenes
VDDTTVKFTLPTVAPAFE

SEQ ID NO: 11369 - protein, 25 aa, Mus sp.
ASFDPQGGLQNIAVVKHNLGVLTKR

SEQ ID NO: 11370 - protein, 16 aa, Mus sp.
IGGDPFAAPQVVPAFA

SEQ ID NO: 11371 - protein, 20 aa, Mus sp.
DVVDRVLKSPVASIVYELNP

SEQ ID NO: 11372 - protein, 28 aa, Mus sp.
LLDFGSLSNLQVTQPTVGMNFKTPRGAV

SEQ ID NO: 11373 - protein, 14 aa, Mus sp.
ASLGWIGSIVSTAL

SEQ ID NO: 11374 - protein, 14 aa, Mus sp.
LQVYAPEVSPESIM

SEQ ID NO: 11375 - protein, 14 aa, Mus sp.
GPPIFNPVANEVYL

SEQ ID NO: 11376 - protein, 17 aa, Mus sp.
VPDVQFKTPQISMSDID

SEQ ID NO: 11377 - protein, 16 aa, Mus sp.
SLVSWVGSEPMPEAGL

SEQ ID NO: 11378 - protein, 15 aa, Mus sp.
FGNIYSTPLALQMLM

SEQ ID NO: 11379 - protein, 17 aa, Mus sp.
YKKELEEQLGPVAEETR

SEQ ID NO: 11380 - protein, 16 aa, Mus sp.
NVDPFKAVDTNRASMG

SEQ ID NO: 11381 - protein, 20 aa, Mus sp.
VPTVPLLPPQVNQSLASMPP

SEQ ID NO: 11382 - protein, 15 aa, Mus sp.
LPDVYDWPESSLTPP

SEQ ID NO: 11383 - protein, 30 aa, Mus sp.; identical to SEQ ID NO: 3326

SEQ ID NO: 11384 - protein, 14 aa, Mus sp.
IPEFQLPHLSHTIE

SEQ ID NO: 11385 - protein, 14 aa, Mus sp.
DLLYSFPVVIKNKT

SEQ ID NO: 11386 - protein, 14 aa, Mus sp.
DPDGFSWPATLPSV

SEQ ID NO: 11387 - protein, 13 aa, Mus sp.
SVGAWTGPMGNWA

SEQ ID NO: 11388 - protein, 16 aa, Mus sp.
DPIQKYLTPQMATSIT

SEQ ID NO: 11389 - protein, 18 aa, Mus sp.
DDEKVRVSYYGPKTSPVQ

SEQ ID NO: 11390 - protein, 16 aa, Mus sp.
NLRDNYRFAHTNIESL

SEQ ID NO: 11391 - protein, 17 aa, Mus sp.
LDLLDLAPEPRYAHIPV

SEQ ID NO: 11392 - protein, 17 aa, Mus sp.
AKPSGYNPPISILGILE

SEQ ID NO: 11393 - protein, 18 aa, Mus sp.
STHSNSISFGSAPTTSVS

SEQ ID NO: 11394 - protein, 17 aa, Mus sp.
RDGDSYRSPWSNKYDPP

SEQ ID NO: 11395 - protein, 16 aa, Mus sp.
GNSEFDPPGPNVATTT

SEQ ID NO: 11396 - protein, 15 aa, Mus sp.
YFETAVSRPGLEEPR

SEQ ID NO: 11397 - protein, 22 aa, Mus sp.
INPDEAVAYGAAVQAAILSGDK

SEQ ID NO: 11398 - protein, 21 aa, Listeria monocytogenes
STVVVEAGDTLWGIAQSKGTT

SEQ ID NO: 11399 - protein, 14 aa, Mus sp.
VTQFHPPHIEIQML

SEQ ID NO: 11400 - protein, 16 aa, Mus sp.
QNAWFLPAQADIVATK

SEQ ID NO: 11401 - protein, 16 aa, Mus sp.
MPDMHFKAPKISMPDV

SEQ ID NO: 11402 - protein, 24 aa, Mus sp.
NVDPFKAVDTNRASMGQASPESKG

SEQ ID NO: 11403 - protein, 15 aa, Mus sp.
GTPFWMAPEVIQEIG

SEQ ID NO: 11404 - protein, 22 aa, Mus sp.
KDEGKLLEAKGPVTDVAYSHDG

SEQ ID NO: 11405 - protein, 22 aa, BOVIN
AGPPVASVVVGPSVVAVPLPLH

SEQ ID NO: 11406 - protein, 16 aa, Mus sp.
AQLNYWSAKSLWAKLD

SEQ ID NO: 11407 - protein, 17 aa, Mus sp.
FPTDYPFKPPKVAFTTR

SEQ ID NO: 11408 - protein, 21 aa, Mus sp.
LPGNLDYWTYPGSLTTPPLLE

SEQ ID NO: 11409 - protein, 18 aa, Mus sp.
GSILWSQPLPSLPGGPPS

SEQ ID NO: 11410 - protein, 15 aa, BOVIN
ASVVVGPSVVAVPLP

SEQ ID NO: 11411 - protein, 16 aa, Mus sp.
KPEDYQGGRTGEAIVD

SEQ ID NO: 11412 - protein, 20 aa, Mus sp.
GADKTVKGPDGLTALEATDN

SEQ ID NO: 11413 - protein, 21 aa, Listeria monocytogenes
APGQETQHYYGLPVADSAIDR

SEQ ID NO: 11414 - protein, 14 aa, Mus sp.
GVLLPFFDPDTNIV

SEQ ID NO: 11415 - protein, 22 aa, Mus sp.
GPHSMRYFETAVSRPGLEEPRY

SEQ ID NO: 11416 - protein, 16 aa, Mus sp.
KEDRRYNPPIIHQGFQ

SEQ ID NO: 11417 - protein, 16 aa, Mus sp.
DPTNPFRFPNIGVEKF

SEQ ID NO: 11418 - protein, 21 aa, Mus sp.
DVVDRVLKSPVASIVYELNPN

SEQ ID NO: 11419 - protein, 16 aa, Mus sp.
DPDGFSWPATLPSVYK

SEQ ID NO: 11420 - protein, 20 aa, Mus sp.
EMEKEDRRYNPPIIHQGFQD

SEQ ID NO: 11421 - protein, 18 aa, Mus sp.
NPTDEYLDAMMNEAPGPI

SEQ ID NO: 11422 - protein, 17 aa, Mus sp.
LPSTWSDPSVNISLDNL

SEQ ID NO: 11423 - protein, 22 aa, Mus sp.
VPPGLEFLVQIDQILIHQKAER

SEQ ID NO: 11424 - protein, 19 aa, Mus sp.
YPSQASIYSPPAAAAAAAA

SEQ ID NO: 11425 - protein, 15 aa, Mus sp.
EDPDGFSWPATLPSV

SEQ ID NO: 11426 - protein, 15 aa, Mus sp.
TIQWWNMPSPNVDPY

SEQ ID NO: 11427 - protein, 12 aa, Mus sp.
KQIVWNGPVGVF

SEQ ID NO: 11428 - protein, 10 aa, Mus sp.
YTPIPNGLYP

SEQ ID NO: 11429 - protein, 19 aa, Mus sp.
EMEKEDRRYNPPIIHQGFQ

SEQ ID NO: 11430 - protein, 17 aa, Mus sp.
YPTPAYTIPFYTPIPNG

SEQ ID NO: 11431 - protein, 15 aa, Mus sp.
VYIFYGASIASLSAS

SEQ ID NO: 11432 - protein, 15 aa, Mus sp.
YTIPFYTPIPNGLYP

SEQ ID NO: 11433 - protein, 17 aa, Mus sp.
MPDMHFKAPKISMPDVD

SEQ ID NO: 11434 - protein, 19 aa, Mus sp.
IGDSNFGAPSASVAAAPAP

SEQ ID NO: 11435 - protein, 19 aa, Mus sp.
TDDEKVRVSYYGPKTSPVQ

SEQ ID NO: 11436 - protein, 14 aa, Mus sp.
TQLIRNGDWTFQVL

SEQ ID NO: 11437 - protein, 13 aa, Mus sp.
EDNVFEAPTLVKV

SEQ ID NO: 11438 - protein, 15 aa, Mus sp.
YYLPYKSPGINVDSS

SEQ ID NO: 11439 - protein, 21 aa, Mus sp.
NPEPPPPRSHYSNIEANESEE

SEQ ID NO: 11440 - protein, 15 aa, Mus sp.
EVEFSAPYPMEVIFE

SEQ ID NO: 11441 - protein, 16 aa, Mus sp.
DEEEVEVFLPKFKLEE

SEQ ID NO: 11442 - protein, 17 aa, Mus sp.
DPTNPFRFPNIGVEKFL

SEQ ID NO: 11443 - protein, 19 aa, Mus sp.
GDFYPFDGPSGLLAHAFPP

SEQ ID NO: 11444 - protein, 12 aa, Mus sp.
TIPFYTPIPNGL

SEQ ID NO: 11445 - protein, 17 aa, Mus sp.
KLLEAKGPVTDVAYSHD

SEQ ID NO: 11446 - protein, 15 aa, Mus sp.
FGNSEFDPPGPNVAT

SEQ ID NO: 11447 - protein, 17 aa, Mus sp.
FPTLKFFPASADRTVID

SEQ ID NO: 11448 - protein, 15 aa, Mus sp.
GTPEYLAPEIILSKG

SEQ ID NO: 11449 - protein, 15 aa, Mus sp.
REVSSVEAPSVSPAR

SEQ ID NO: 11450 - protein, 12 aa, Mus sp.
EFIWPAVQSSAL

SEQ ID NO: 11451 - protein, 19 aa, Mus sp.
SPLPILSPTVSPSPSPIPP

SEQ ID NO: 11452 - protein, 15 aa, Mus sp.
LSLLYKVPYVAQEIQ

SEQ ID NO: 11453 - protein, 18 aa, Mus sp.
NPTLDHYKEPSAIFQLPY

SEQ ID NO: 11454 - protein, 17 aa, Listeria monocytogenes
DDTTVKFTLPTVAPAFE

SEQ ID NO: 11455 - protein, 17 aa, Mus sp.
SPNKLYTLVTYVPVTTF

SEQ ID NO: 11456 - protein, 16 aa, Mus sp.
DGDSYRSPWSNKYDPP

SEQ ID NO: 11457 - protein, 14 aa, Mus sp.
AGGHKLGLGLEFQA

SEQ ID NO: 11458 - protein, 15 aa, Mus sp.
AVLEQEPIVLPAWDP

SEQ ID NO: 11459 - protein, 19 aa, Mus sp.
LTGMAFRVPTPNVSVVDLT

SEQ ID NO: 11460 - protein, 16 aa, Mus sp.
EQFSYVLPTVHSLEPS

SEQ ID NO: 11461 - protein, 17 aa, Mus sp.
GEFDYSGSQAIKALKEE

SEQ ID NO: 11462 - protein, 14 aa, Mus sp.
VNFQEYVAFLGALA

SEQ ID NO: 11463 - protein, 16 aa, Mus sp.
EEEEVEVFLPKFKLEE

SEQ ID NO: 11464 - protein, 16 aa, Mus sp.
SPDQWSSSSPHSASDW

SEQ ID NO: 11465 - protein, 17 aa, Mus sp.
TKKFRFEEPVVLPDLSD

SEQ ID NO: 11466 - protein, 17 aa, Mus sp.
GPGGLWVWGAPAVAQLL

SEQ ID NO: 11467 - protein, 17 aa, Mus sp.
KPEDYQGGRTGEAIVDA

SEQ ID NO: 11468 - protein, 16 aa, Mus sp.
IPSGLFIPSMAVGAIA

SEQ ID NO: 11469 - protein, 15 aa, Mus sp.
SFVDYQTTMVRTAKA

SEQ ID NO: 11470 - protein, 18 aa, Mus sp.
TGVPTVPLLPPQVNQSLA

SEQ ID NO: 11471 - protein, 16 aa, Mus sp.
QGGVYASPSIAGSRPG

SEQ ID NO: 11472 - protein, 18 aa, Mus sp.
EQIYYAGPVNNPGLDVPQ

SEQ ID NO: 11473 - protein, 16 aa, Mus sp.
AEPQAEAPAAAASSEQ

SEQ ID NO: 11474 - protein, 18 aa, Mus sp.
APGGYPAAGPYGVPAGPL

SEQ ID NO: 11475 - protein, 14 aa, Mus sp.
AVLEQEPIVLPAWD

SEQ ID NO: 11476 - protein, 16 aa, Mus sp.
ISVAVATPRGLVVPVI

SEQ ID NO: 11477 - protein, 15 aa, Mus sp.
RTDWEAPTGQPSAPG

SEQ ID NO: 11478 - protein, 15 aa, Mus sp.
EPSVFNGPEVTMLKD

SEQ ID NO: 11479 - protein, 14 aa, Mus sp.
ISVAVATPRGLVVP

SEQ ID NO: 11480 - protein, 14 aa, Mus sp.
LDIDSAPITARNTG

SEQ ID NO: 11481 - protein, 18 aa, Mus sp.
EKEDRRYNPPIIHQGFQD

SEQ ID NO: 11482 - protein, 14 aa, Mus sp.
SVGAWTGPMGNWAM

SEQ ID NO: 11483 - protein, 14 aa, Mus sp.
VATENGYSYPVVSY

SEQ ID NO: 11484 - protein, 17 aa, Mus sp.
YVELPPSVSQAAKSPPG

SEQ ID NO: 11485 - protein, 19 aa, Mus sp.
KPTVTVVSPLPNDSINPQP

SEQ ID NO: 11486 - protein, 23 aa, Mus sp.
TPARAPETRSQVTPSVPSEALDD

SEQ ID NO: 11487 - protein, 16 aa, Mus sp.
YPNSFSAPEQQRSALE

SEQ ID NO: 11488 - protein, 16 aa, Mus sp.
SGPKPFSAPKPQTSPS

SEQ ID NO: 11489 - protein, 15 aa, Mus sp.
AINDYKGAVIVVSHD

SEQ ID NO: 11490 - protein, 9 aa, Mus sp.
YIAPEILQG

SEQ ID NO: 11491 - protein, 16 aa, Mus sp.
YPDSWSTPHSYFSLKF

SEQ ID NO: 11492 - protein, 14 aa, Mus sp.
SKATYSTNSPVWEE

SEQ ID NO: 11493 - protein, 13 aa, Mus sp.
VLLPFFDPDTNIV

SEQ ID NO: 11494 - protein, 18 aa, Mus sp.
TRSQVTPSVPSEALDDST

SEQ ID NO: 11495 - protein, 15 aa, Mus sp.
DPTNPFRFPNIGVEK

SEQ ID NO: 11496 - protein, 12 aa, Mus sp.
VQIYHNPTANSF

SEQ ID NO: 11497 - protein, 15 aa, Mus sp.
TIPFYTPIPNGLYPS

SEQ ID NO: 11498 - protein, 16 aa, Mus sp.
DISNYGFPRSVQAIDA

SEQ ID NO: 11499 - protein, 18 aa, Mus sp.
ARDNMFSGSKINYTENRA

SEQ ID NO: 11500 - protein, 19 aa, Mus sp.
DDREDITHTYKYPEGSPEE

SEQ ID NO: 11501 - protein, 11 aa, Mus sp.
GIYTYGKPVPG

SEQ ID NO: 11502 - protein, 19 aa, Mus sp.
EDYVELPPSVSQAATSPPG

SEQ ID NO: 11503 - protein, 17 aa, Mus sp.
AEIEYAMAYSKAAFERE

SEQ ID NO: 11504 - protein, 17 aa, Mus sp.
INPDNVATPIAASFGDL

SEQ ID NO: 11505 - protein, 15 aa, Mus sp.
LSLLYNVPAVAEEIQ

SEQ ID NO: 11506 - protein, 12 aa, Mus sp.
IQEPYTFPAILK

SEQ ID NO: 11507 - protein, 14 aa, Mus sp.
VEFSAPYPMEVIFE

SEQ ID NO: 11508 - protein, 19 aa, Mus sp.
EKEDRRYNPPIIHQGFQDT

SEQ ID NO: 11509 - protein, 25 aa, Mus sp.
GPPIDIGRVTGPPIFNPVANEVYLN

SEQ ID NO: 11510 - protein, 18 aa, Mus sp.
VPAQSTFWRPQTQEERPH

SEQ ID NO: 11511 - protein, 12 aa, Mus sp.
VGAWTGPMGNWA

SEQ ID NO: 11512 - protein, 19 aa, Mus sp.
EDFLKKWETPSQNTAQLDQ

SEQ ID NO: 11513 - protein, 8 aa, Mus sp.
SNYVFVFL

SEQ ID NO: 11514 - protein, 17 aa, Mus sp.
IESKEAFQEALAAAGDK

SEQ ID NO: 11515 - protein, 16 aa, Mus sp.
ENPIYKSAVTTVVNPK

SEQ ID NO: 11516 - protein, 16 aa, Mus sp.
KSFVQNYPVVSIEDPF

SEQ ID NO: 11517 - protein, 15 aa, Mus sp.
SALEYGMPVTLIGEA

SEQ ID NO: 11518 - protein, 14 aa, Mus sp.
APGGYVAPKAVWLP

SEQ ID NO: 11519 - protein, 19 aa, Mus sp.
VDFVAWATGEPNFANDDEN

SEQ ID NO: 11520 - protein, 13 aa, Mus sp.
NERFRCPEAIFQP

SEQ ID NO: 11521 - protein, 17 aa, Mus sp.
TKNLDYVATSIHEAVTK

SEQ ID NO: 11522 - protein, 15 aa, Mus sp.
KPSGYNPPISILGIL

SEQ ID NO: 11523 - protein, 16 aa, Mus sp.
VMRIINEPTAAAIAYG

SEQ ID NO: 11524 - protein, 18 aa, Mus sp.
SQMAQYFEPLTLAAVGAA

SEQ ID NO: 11525 - protein, 11 aa, Mus sp.
ANVGWNGSTFA

SEQ ID NO: 11526 - protein, 14 aa, Mus sp.
EDNWSLPNRAVEPQ

SEQ ID NO: 11527 - protein, 17 aa, Mus sp.
SPPPYAAYATPTPEVYG

SEQ ID NO: 11528 - protein, 16 aa, Mus sp.
ASLELLEGKVLPGVDA

SEQ ID NO: 11529 - protein, 18 aa, Mus sp.
DKDPFWWNGAEPIWVTNQ

SEQ ID NO: 11530 - protein, 12 aa, Mus sp.
VNWYAPLVAPIS

SEQ ID NO: 11531 - protein, 21 aa, Mus sp.
DEGKLLEAKGPVTDVAYSHDG

SEQ ID NO: 11532 - protein, 15 aa, Mus sp.
LDQLFSGPLPGRLPV

SEQ ID NO: 11533 - protein, 15 aa, Mus sp.
VELPPSVSQAAKSPP

SEQ ID NO: 11534 - protein, 15 aa, Mus sp.
SPTGNIFFSPFSISS

SEQ ID NO: 11535 - protein, 16 aa, Mus sp.
DDLFVEEPKTNDVKDS

SEQ ID NO: 11536 - protein, 17 aa, Mus sp.
KPGSDTIKPDVNKSKEY

SEQ ID NO: 11537 - protein, 16 aa, Mus sp.
MPDMHFKTPKISMPDV

SEQ ID NO: 11538 - protein, 12 aa, Mus sp.
DDIEADHVGTYG

SEQ ID NO: 11539 - protein, 15 aa, Mus sp.
GSLFLKTPKIVSSKD

SEQ ID NO: 11540 - protein, 15 aa, Mus sp.
TTVSLSAPDALKIIT

SEQ ID NO: 11541 - protein, 14 aa, Mus sp.
RPDAEYWNSQPEIL

SEQ ID NO: 11542 - protein, 17 aa, Mus sp.
MPDMHFKTPKISMPDVD

SEQ ID NO: 11543 - protein, 17 aa, Mus sp.
VPDDLLYSFPVVIKNKT

SEQ ID NO: 11544 - protein, 19 aa, Mus sp.
SGPKPFSAPKPQTSPSPKP

SEQ ID NO: 11545 - protein, 14 aa, Mus sp.
EPVWRSEQAIGAIA

SEQ ID NO: 11546 - protein, 20 aa, Mus sp.
APSNYLNNPYVRKALHIPES

SEQ ID NO: 11547 - protein, 17 aa, Mus sp.
ESPDQWSSSSPHSASDW

SEQ ID NO: 11548 - protein, 20 aa, Mus sp.
LPPYDDATAVPSTAKEPPPP

SEQ ID NO: 11549 - protein, 18 aa, Mus sp.
HPPQEATNSPKPQPSYEE

SEQ ID NO: 11550 - protein, 24 aa, Mus sp.
SPDDADFVDVLHTFTRGSPGRSIG

SEQ ID NO: 11551 - protein, 15 aa, Mus sp.
VDMARVVAPFMSNIP

SEQ ID NO: 11552 - protein, 22 aa, Mus sp.
KPAAAKPAATRPLAAAIRPVAT

SEQ ID NO: 11553 - protein, 16 aa, Mus sp.
DELSKTISPMVMDAKA

SEQ ID NO: 11554 - protein, 18 aa, Mus sp.
EPTTLFKTASALRSSAPL

SEQ ID NO: 11555 - protein, 17 aa, Listeria monocytogenes
TKEKVVATPVSNVSTSS

SEQ ID NO: 11556 - protein, 15 aa, Mus sp.
LELEEPPLVLAAANV

SEQ ID NO: 11557 - protein, 19 aa, Mus sp.
EDYVELPPSVSQAAKSPPG

SEQ ID NO: 11558 - protein, 18 aa, Mus sp.
LPGNLDYWTYPGSLTTPP

SEQ ID NO: 11559 - protein, 15 aa, Mus sp.
APPLPIKTPIPTPST

SEQ ID NO: 11560 - protein, 16 aa, Mus sp.
SVGAWTGPMGNWAMFT

SEQ ID NO: 11561 - protein, 14 aa, Mus sp.
LSYAVSWAKVSESG

SEQ ID NO: 11562 - protein, 26 aa, Mus sp.
VEWTNNGKTELNYKNTEPVLDSDGSY

SEQ ID NO: 11563 - protein, 14 aa, Mus sp.
TTVEYLAPWANQID

SEQ ID NO: 11564 - protein, 16 aa, Mus sp.
LLLHWQPPLSHNGVLT

SEQ ID NO: 11565 - protein, 17 aa, Mus sp.
GPGSAVSPYPSFNVSSD

SEQ ID NO: 11566 - protein, 17 aa, Mus sp.
SSIASFKDPKISTSLPV

SEQ ID NO: 11567 - protein, 14 aa, Mus sp.
YLPYKSPGINVDSS

SEQ ID NO: 11568 - protein, 13 aa, Mus sp.
SFKDPKISTSLPV

SEQ ID NO: 11569 - protein, 16 aa, Listeria monocytogenes
VERWNEKYAQAYPNVS

SEQ ID NO: 11570 - protein, 28 aa, Mus sp.
KVIPELNGKLTGMAFRVPTPNVSVVDLT

SEQ ID NO: 11571 - protein, 13 aa, Mus sp.
DLLYSFPVVIKNK

SEQ ID NO: 11572 - protein, 18 aa, Mus sp.
FPKPPSYNVATTLPSYDE

SEQ ID NO: 11573 - protein, 16 aa, Mus sp.
FPPEFYEHAKALWEDE

SEQ ID NO: 11574 - protein, 17 aa, Mus sp.
FPPEFYEHAKALWEDEG

SEQ ID NO: 11575 - protein, 14 aa, Mus sp.
AGGHKVGLGFELEA

SEQ ID NO: 11576 - protein, 17 aa, Mus sp.
LKYHFVTPLTSMVVTKP

SEQ ID NO: 11577 - protein, 18 aa, Mus sp.
EDYVELPPSVSQAATSPP

SEQ ID NO: 11578 - protein, 14 aa, Mus sp.
TGVDFIGSTVGLAK

SEQ ID NO: 11579 - protein, 21 aa, Mus sp.
DYNRDGDSYRSPWSNKYDPPL

SEQ ID NO: 11580 - protein, 18 aa, Mus sp.
LPQLRNVGGVRAIPYMQV

SEQ ID NO: 11581 - protein, 16 aa, Mus sp.
GVPTVPLLPPQVNQSL

SEQ ID NO: 11582 - protein, 15 aa, Mus sp.
GRPDAEYWNSQPEIL

SEQ ID NO: 11583 - protein, 17 aa, Mus sp.
VDEYDYSKPIQGQQKKP

SEQ ID NO: 11584 - protein, 16 aa, Mus sp.
PPSYYTQPVPVPNANA

SEQ ID NO: 11585 - protein, 14 aa, Mus sp.
NIPYFETSAKEAIN

SEQ ID NO: 11586 - protein, 18 aa, Mus sp.
SPPPGGYGQPSVLPGGYP

SEQ ID NO: 11587 - protein, 18 aa, Mus sp.
AARDNMFSGSKINYTENR

SEQ ID NO: 11588 - protein, 16 aa, Mus sp.
LTVLEGDPYFTGKLQD

SEQ ID NO: 11589 - protein, 16 aa, Mus sp.
DVQLVESGGGLVQPGG

SEQ ID NO: 11590 - protein, 16 aa, Mus sp.
GGPGSAVSPYPSFNVS

SEQ ID NO: 11591 - protein, 20 aa, Mus sp.
EEKPVPAAPVPSPVAPAPVP

SEQ ID NO: 11592 - protein, 22 aa, Mus sp.
RAPETRSQVTPSVPSEALDDST

SEQ ID NO: 11593 - protein, 25 aa, Mus sp.
IPELNGKLTGMAFRVPTPNVSVVDL

SEQ ID NO: 11594 - protein, 16 aa, Mus sp.
SSIASFKDPKISTSLP

SEQ ID NO: 11595 - protein, 15 aa, Mus sp.
VYTRYHCSLPVPEPS

SEQ ID NO: 11596 - protein, 19 aa, Mus sp.
LPPYDDATAVPSTAKEPPP

SEQ ID NO: 11597 - protein, 15 aa, Mus sp.
GQNAWFLPAQADIVA

SEQ ID NO: 11598 - protein, 12 aa, Mus sp.
RQTTQYPEANAL

SEQ ID NO: 11599 - protein, 14 aa, Mus sp.
EPSVFNGPEVTMLK

SEQ ID NO: 11600 - protein, 20 aa, Mus sp.
DDGHGGYKPFQNPVPNQSPS

SEQ ID NO: 11601 - protein, 26 aa, Mus sp.
TTILYKLKGNQLVDTLPTVGFNVEPL

SEQ ID NO: 11602 - protein, 16 aa, Mus sp.
LDSQYRASAPNSHVPL

SEQ ID NO: 11603 - protein, 16 aa, Mus sp.
GSLFLKTPKIVSSKDY

SEQ ID NO: 11604 - protein, 17 aa, Mus sp.
YVELPPSVSQAATSPPG

SEQ ID NO: 11605 - protein, 16 aa, Mus sp.
DGELTYENVQVSPVPG

SEQ ID NO: 11606 - protein, 20 aa, Mus sp.
EPPPAYEPPAPAPAPLPPPS

SEQ ID NO: 11607 - protein, 13 aa, Mus sp.
LSYREPDPEDAVG

SEQ ID NO: 11608 - protein, 18 aa, Mus sp.
KHWGEWSPAHPLEAEDTR

SEQ ID NO: 11609 - protein, 8 aa, BOVIN
VYPFPGPI

SEQ ID NO: 11610 - protein, 14 aa, Mus sp.
YYLPYKSPGINVDS

SEQ ID NO: 11611 - protein, 15 aa, Mus sp.
HIPEFQLPHLSHTIE

SEQ ID NO: 11612 - protein, 17 aa, Mus sp.
MPDMHFKTPKISMPDID

SEQ ID NO: 11613 - protein, 12 aa, Mus sp.
VEYEASAAGLIR

SEQ ID NO: 11614 - protein, 12 aa, Mus sp.
DHVDFSQPEPHT

SEQ ID NO: 11615 - protein, 15 aa, Mus sp.
GPVPWLGPQTDEAIK

SEQ ID NO: 11616 - protein, 15 aa, Mus sp.
AVDVFFPPEAQNDFP

SEQ ID NO: 11617 - protein, 15 aa, Mus sp.
HTLFHNPHVNPLPTG

SEQ ID NO: 11618 - protein, 28 aa, Mus sp.
NVDPFKAVDTNRASMGQASPESKGFTDL

SEQ ID NO: 11619 - protein, 18 aa, Mus sp.
YPTPAYTIPFYTPIPNGL

SEQ ID NO: 11620 - protein, 15 aa, Mus sp.
DRRYNPPIIHQGFQD

SEQ ID NO: 11621 - protein, 15 aa, Mus sp.
GVLLPFFDPDTNIVY

SEQ ID NO: 11622 - protein, 20 aa, Mus sp.
SSSIASFKDPKISTSLPVLD

SEQ ID NO: 11623 - protein, 15 aa, Mus sp.
TAQYKCPVAMEEADD

SEQ ID NO: 11624 - protein, 18 aa, Mus sp.
GQDHVDFSQPEPHTVLFH

SEQ ID NO: 11625 - protein, 18 aa, Mus sp.
EETELDQLFSGPLPGRLP

SEQ ID NO: 11626 - protein, 19 aa, Mus sp.
IDLKGIPVYRFVLPANAFA

SEQ ID NO: 11627 - protein, 34 aa, Listeria monocytogenes; identical to SEQ ID NO: 591

SEQ ID NO: 11628 - protein, 16 aa, Mus sp.
ASVATNPIITPVAQEN

SEQ ID NO: 11629 - protein, 21 aa, Mus sp.
HPDKGGSPYIAAKINEAKDLL

SEQ ID NO: 11630 - protein, 15 aa, Mus sp.
SIVYWMTSQPSDAVR

SEQ ID NO: 11631 - protein, 20 aa, Mus sp.
IGDSNFGAPSASVAAAPAPA

SEQ ID NO: 11632 - protein, 12 aa, Mus sp.
LIRNGDWTFQVL

SEQ ID NO: 11633 - protein, 16 aa, Mus sp.
VKQYYEVPIAMKSVFD

SEQ ID NO: 11634 - protein, 19 aa, Mus sp.
EPPPPRSHYSNIEANESEE

SEQ ID NO: 11635 - protein, 18 aa, Mus sp.
SLVLFCRVYRVWVLVVGG

SEQ ID NO: 11636 - protein, 18 aa, Mus sp.
LTGMAFRVPTPNVSVVDL

SEQ ID NO: 11637 - protein, 15 aa, Listeria monocytogenes
GINQAYTGSTALSDG

SEQ ID NO: 11638 - protein, 16 aa, Mus sp.
YIEGYVPSQADVAVFE

SEQ ID NO: 11639 - protein, 16 aa, Mus sp.
VTRQTTQYPEANALVR

SEQ ID NO: 11640 - protein, 14 aa, Mus sp.
GPVAPFVAAIPLLA

SEQ ID NO: 11641 - protein, 20 aa, Mus sp.
DSVTTDHISPAGNIARNSPA

SEQ ID NO: 11642 - protein, 14 aa, Mus sp.
SMIVNVSCTSACTD

SEQ ID NO: 11643 - protein, 14 aa, Mus sp.
LELEEPPLVLAAAN

SEQ ID NO: 11644 - protein, 14 aa, Mus sp.
VIYTHPEVAWVGKS

SEQ ID NO: 11645 - protein, 17 aa, Mus sp.
DSPDVVYSPETIEARYE

SEQ ID NO: 11646 - protein, 17 aa, Mus sp.
IPEQSFYTKPLPGIIMG

SEQ ID NO: 11647 - protein, 15 aa, Mus sp.
GELTYENVQVSPVPG

SEQ ID NO: 11648 - protein, 26 aa, Mus sp.
VIPELNGKLTGMAFRVPTPNVSVVDL

SEQ ID NO: 11649 - protein, 14 aa, Mus sp.
APDTRFVAPGALGN

SEQ ID NO: 11650 - protein, 15 aa, Listeria monocytogenes
ERWNEKYAQAYPNVS

SEQ ID NO: 11651 - protein, 23 aa, Mus sp.
NPEPPPPRSHYSNIEANESEEVR

SEQ ID NO: 11652 - protein, 15 aa, Mus sp.
DDPIWRGPLPSNGVM

SEQ ID NO: 11653 - protein, 17 aa, Mus sp.
VQIPKVVKSPSSLPAKP

SEQ ID NO: 11654 - protein, 8 aa, Mus sp.
SSIASFKD

SEQ ID NO: 11655 - protein, 16 aa, Mus sp.
NTAQYKCPVAMEEADD

SEQ ID NO: 11656 - protein, 16 aa, Mus sp.
SIASFKDPKISTSLPV

SEQ ID NO: 11657 - protein, 15 aa, Mus sp.
EDRRYNPPIIHQGFQ

SEQ ID NO: 11658 - protein, 15 aa, Mus sp.
YLNEYGAPDAGGLEH

SEQ ID NO: 11659 - protein, 22 aa, Mus sp.
AVNKGFYKEATQLWGKAEMIIE

SEQ ID NO: 11660 - protein, 16 aa, Mus sp.
AAYLWVGAGASEAEKT

SEQ ID NO: 11661 - protein, 21 aa, Mus sp.
DPTPDPNTAYASYPSASVENY

SEQ ID NO: 11662 - protein, 13 aa, Mus sp.
EDNWSLPNRAVEP

SEQ ID NO: 11663 - protein, 16 aa, Mus sp.
KKELEEQLGPVAEETR

SEQ ID NO: 11664 - protein, 14 aa, Mus sp.
TSSYSNPTIGYENR

SEQ ID NO: 11665 - protein, 16 aa, Mus sp.
DIYVWRGAQATLSNTT

SEQ ID NO: 11666 - protein, 12 aa, Mus sp.
YNPPIIHQGFQD

SEQ ID NO: 11667 - protein, 19 aa, Mus sp.
TNNQDFRGSAGAPSVENVK

SEQ ID NO: 11668 - protein, 18 aa, Mus sp.
TGTTVYRQFWIFDVQNPD

SEQ ID NO: 11669 - protein, 16 aa, Mus sp.
GEQKLFISPGLLPEAP

SEQ ID NO: 11670 - protein, 15 aa, Mus sp.
KQREEYQPATPGLGM

SEQ ID NO: 11671 - protein, 18 aa, Mus sp.
GADKTVKGPDGLTALEAT

SEQ ID NO: 11672 - protein, 17 aa, Mus sp.
GIHHWTPPKGHVDPGEN

SEQ ID NO: 11673 - protein, 14 aa, Mus sp.
SLFLKTPKIVSSKD

SEQ ID NO: 11674 - protein, 17 aa, Mus sp.
LPKEELYMPPLVIKVID

SEQ ID NO: 11675 - protein, 13 aa, Mus sp.
DVFLGPYVAVFDR

SEQ ID NO: 11676 - protein, 16 aa, Mus sp.
SVATNPIITPVAQENQ

SEQ ID NO: 11677 - protein, 18 aa, Mus sp.
APPLPIKTPIPTPSTLPA

SEQ ID NO: 11678 - protein, 17 aa, Mus sp.
GPVPEFSGATVERVSED

SEQ ID NO: 11679 - protein, 16 aa, Mus sp.
IGRTWNDPSVQQDIKF

SEQ ID NO: 11680 - protein, 14 aa, BOVIN
VVVGPSVVAVPLPL

SEQ ID NO: 11681 - protein, 16 aa, Mus sp.
QDPTFHTPLDLYAYAR

SEQ ID NO: 11682 - protein, 19 aa, Mus sp.
EAARDNMFSGSKINYTENR

SEQ ID NO: 11683 - protein, 18 aa, Listeria monocytogenes
GGINQAYTGSTALSDGLN

SEQ ID NO: 11684 - protein, 15 aa, Mus sp.
LLLHWQPPLSHNGVL

SEQ ID NO: 11685 - protein, 22 aa, Mus sp.
KPTVTVVSPLPNDSINPQPSPD

SEQ ID NO: 11686 - protein, 16 aa, Mus sp.
RDNMFSGSKINYTENR

SEQ ID NO: 11687 - protein, 8 aa, Mus sp.
AVYAFLGL

SEQ ID NO: 11688 - protein, 14 aa, Mus sp.
RNIYWTDSVPGSVS

SEQ ID NO: 11689 - protein, 17 aa, Mus sp.
EKEDRRYNPPIIHQGFQ

SEQ ID NO: 11690 - protein, 19 aa, Mus sp.
DPTPDPNTAYASYPSASVE

SEQ ID NO: 11691 - protein, 15 aa, Mus sp.
TTSSYSNPTIGYENR

SEQ ID NO: 11692 - protein, 15 aa, Mus sp.
ANPDFTQPISEVVDE

SEQ ID NO: 11693 - protein, 23 aa, Mus sp.
LPEEVGEYRQPSGGSVPVSPGPP

SEQ ID NO: 11694 - protein, 9 aa, Mus sp.
FAYEGRDYI

SEQ ID NO: 11695 - protein, 15 aa, Mus sp.
TPATNEAPQATVFPK

SEQ ID NO: 11696 - protein, 19 aa, Mus sp.
NFHQRFESPDSQASAEQPE

SEQ ID NO: 11697 - protein, 17 aa, Mus sp.
TPDPNTAYASYPSASVE

SEQ ID NO: 11698 - protein, 15 aa, Mus sp.
IYEGYALPHAILRLD

SEQ ID NO: 11699 - protein, 15 aa, Mus sp.
LGDVFLGPYVAVFDR

SEQ ID NO: 11700 - protein, 14 aa, Mus sp.
HVEGYEGSAASIST

SEQ ID NO: 11701 - protein, 15 aa, Mus sp.
FYLALPPTVYEAVTK

SEQ ID NO: 11702 - protein, 19 aa, Mus sp.
SPVSETVVTPEAAPEKNPV

SEQ ID NO: 11703 - protein, 14 aa, Mus sp.
IPFYTPIPNGLYPS

SEQ ID NO: 11704 - protein, 15 aa, Mus sp.
TVTYEWAPPVQNQAL

SEQ ID NO: 11705 - protein, 17 aa, Mus sp.
VLRYNITHPVVNDADAS

SEQ ID NO: 11706 - protein, 16 aa, Mus sp.
DAGNAFKKADPQEAIN

SEQ ID NO: 11707 - protein, 11 aa, Mus sp.
HDLDFRAPHVL

SEQ ID NO: 11708 - protein, 23 aa, Mus sp.
PGPNIGGDTHFDSAEPWTVQNED

SEQ ID NO: 11709 - protein, 16 aa, Mus sp.
GGSPYIAAKINEAKDL

SEQ ID NO: 11710 - protein, 14 aa, Mus sp.
GVYASPSIAGSRPG

SEQ ID NO: 11711 - protein, 17 aa, Mus sp.
SPDDPSRYITPDQLADL

SEQ ID NO: 11712 - protein, 12 aa, Mus sp.
VFFPPEAQNDFP

SEQ ID NO: 11713 - protein, 15 aa, Mus sp.
EVGEYRQPSGGSVPV

SEQ ID NO: 11714 - protein, 19 aa, Mus sp.
ENHIEVWERPLSNLAWAVA

SEQ ID NO: 11715 - protein, 17 aa, Mus sp.
SPTVHFTPAEISRSVFE

SEQ ID NO: 11716 - protein, 18 aa, Mus sp.
SYPFDFQGAKIITGQEEG

SEQ ID NO: 11717 - protein, 17 aa, Mus sp.
IQEMEKEDRRYNPPIIH

SEQ ID NO: 11718 - protein, 16 aa, Mus sp.
VKSKYKASIAALEAKI

SEQ ID NO: 11719 - protein, 17 aa, Mus sp.
EPYLEPRSPEARGVEAP

SEQ ID NO: 11720 - protein, 21 aa, Mus sp.
QPTGPPPYHESLAGASQPPYN

SEQ ID NO: 11721 - protein, 16 aa, Mus sp.
EYQQYQDATAEEEGEF

SEQ ID NO: 11722 - protein, 14 aa, Mus sp.
ATNPIITPVAQENQ

SEQ ID NO: 11723 - protein, 14 aa, Mus sp.
DRKIVYEGPELNHA

SEQ ID NO: 11724 - protein, 12 aa, Mus sp.
EEAESFADMMKH

SEQ ID NO: 11725 - protein, 18 aa, Mus sp.
SPALVSYASSLPAQVGTI

SEQ ID NO: 11726 - protein, 15 aa, Mus sp.
VKELFTTPVLRASVS

SEQ ID NO: 11727 - protein, 20 aa, Mus sp.
VDPTPDPNTAYASYPSASVE

SEQ ID NO: 11728 - protein, 19 aa, Mus sp.
SPVRFSTETTFLVDKYEIL

SEQ ID NO: 11729 - protein, 14 aa, Mus sp.
SSKNVFLSPMSISS

SEQ ID NO: 11730 - protein, 15 aa, Mus sp.
GKPYVLPSVRKAEAQ

SEQ ID NO: 11731 - protein, 14 aa, Mus sp.
TPEYLAPEIILSKG

SEQ ID NO: 11732 - protein, 18 aa, Mus sp.
SMRYFETAVSRPGLEEPR

SEQ ID NO: 11733 - protein, 31 aa, Mus sp.; identical to SEQ ID NO: 1455

SEQ ID NO: 11734 - protein, 15 aa, Mus sp.
NVDPFKAVDTNRASM

SEQ ID NO: 11735 - protein, 18 aa, Mus sp.
IARQNFTEPTAIQAQGWP

SEQ ID NO: 11736 - protein, 14 aa, Mus sp.
EDNVFEAPTLVKVF

SEQ ID NO: 11737 - protein, 15 aa, Mus sp.
DPTFHTPLDLYAYAR

SEQ ID NO: 11738 - protein, 19 aa, Mus sp.
NRDGDSYRSPWSNKYDPPL

SEQ ID NO: 11739 - protein, 13 aa, Mus sp.
LPYKSPGINVDSS

SEQ ID NO: 11740 - protein, 16 aa, Mus sp.
LSLLYNVPAVAEEIQD

SEQ ID NO: 11741 - protein, 13 aa, Mus sp.
VQNYPVVSIEDPF

SEQ ID NO: 11742 - protein, 15 aa, Mus sp.
DQKFYNFVVIHARAD

SEQ ID NO: 11743 - protein, 15 aa, Mus sp.
SEVYHEPHIADAWPQ

SEQ ID NO: 11744 - protein, 13 aa, Mus sp.
SVGGNMTSMQWAA

SEQ ID NO: 11745 - protein, 16 aa, Mus sp.
AVDVFFPPEAQNDFPV

SEQ ID NO: 11746 - protein, 15 aa, Mus sp.
IEEIEVAPPKAHEVR

SEQ ID NO: 11747 - protein, 27 aa, Mus sp.
YVDPTPDPNTAYASYPSASVENYQQPP

SEQ ID NO: 11748 - protein, 15 aa, Mus sp.
LTPWLAPIVSEGTFD

SEQ ID NO: 11749 - protein, 16 aa, Mus sp.
GIYEYYEPRLSVLPSP

SEQ ID NO: 11750 - protein, 17 aa, Mus sp.
YPNSFSAPEQQRSALEH

SEQ ID NO: 11751 - protein, 15 aa, Mus sp.
GIDPYDQPNAIYIER

SEQ ID NO: 11752 - protein, 14 aa, Mus sp.
APQGSLGEYLFERL

SEQ ID NO: 11753 - protein, 13 aa, Mus sp.
LPDFHVPEITIPE

SEQ ID NO: 11754 - protein, 18 aa, Mus sp.
TKNLDYVATSIHEAVTKI

SEQ ID NO: 11755 - protein, 14 aa, Mus sp.
DNMFSGSKINYTEN

SEQ ID NO: 11756 - protein, 16 aa, Mus sp.
LPNSFDGPVTITIVNR

SEQ ID NO: 11757 - protein, 15 aa, Mus sp.
YTWSSRGPSADGALG

SEQ ID NO: 11758 - protein, 17 aa, Mus sp.
DMFHYTSTTTKVPPPDT

SEQ ID NO: 11759 - protein, 26 aa, Mus sp.
EKWEETELDQLFSGPLPGRLPVNHRP

SEQ ID NO: 11760 - protein, 12 aa, Mus sp.
MKNKELIPLAFF

SEQ ID NO: 11761 - protein, 15 aa, Mus sp.
YPDSWSTPHSYFSLK

SEQ ID NO: 11762 - protein, 18 aa, Mus sp.
GEQIYYAGPVNNPGLDVP

SEQ ID NO: 11763 - protein, 17 aa, Mus sp.
EPTTLFKTASALRSSAP

SEQ ID NO: 11764 - protein, 15 aa, Mus sp.
KERASFITPVPGGVG

SEQ ID NO: 11765 - protein, 18 aa, Mus sp.
IGGDTHFDSAEPWTVQNE

SEQ ID NO: 11766 - protein, 18 aa, Mus sp.
SPPPYAAYATPTPEVYGY

SEQ ID NO: 11767 - protein, 20 aa, Mus sp.
FYVDLDKKETVWMLPEFGQL

SEQ ID NO: 11768 - protein, 14 aa, Mus sp.
VTYEWAPPVQNQAL

SEQ ID NO: 11769 - protein, 15 aa, Mus sp.
PDGFSWPATLPSVYK

SEQ ID NO: 11770 - protein, 15 aa, Mus sp.
EQEVLAPQVVLSLGG

SEQ ID NO: 11771 - protein, 26 aa, Mus sp.
GGLDSLIGDSNFGAPSASVAAAPAPA

SEQ ID NO: 11772 - protein, 14 aa, Mus sp.
LDQLFSGPLPGRLP

SEQ ID NO: 11773 - protein, 15 aa, Mus sp.
FPLATYAPVISAEKA

SEQ ID NO: 11774 - protein, 16 aa, Mus sp.
STDYGNFLANEASPLT

SEQ ID NO: 11775 - protein, 15 aa, Mus sp.
LGTEEISPRVLQSLG

SEQ ID NO: 11776 - protein, 21 aa, Mus sp.
LVVSNITRLIDLPGTELAQLM

SEQ ID NO: 11777 - protein, 17 aa, Mus sp.
MPEMHFKAPKVSLPDVD

SEQ ID NO: 11778 - protein, 15 aa, Mus sp.
NPEAMVAPSVLSNIQ

SEQ ID NO: 11779 - protein, 14 aa, Mus sp.
GPTYRGPVPWHTIN

SEQ ID NO: 11780 - protein, 14 aa, Mus sp.
AIVEYHGPGVDSIS

SEQ ID NO: 11781 - protein, 22 aa, Mus sp.
GVEAARDNMFSGSKINYTENRA

SEQ ID NO: 11782 - protein, 16 aa, Mus sp.
YNPAQQILAYTGLCPP

SEQ ID NO: 11783 - protein, 16 aa, Mus sp.
AQPATAPQAAAAQEPG

SEQ ID NO: 11784 - protein, 18 aa, Mus sp.
APSEERVYMVGKANSVFE

SEQ ID NO: 11785 - protein, 16 aa, Mus sp.
GPEVDVSLPKANIDVS

SEQ ID NO: 11786 - protein, 16 aa, Mus sp.
EEEYYAEPGVTEAEPV

SEQ ID NO: 11787 - protein, 15 aa, Mus sp.
NRPAFMPSEGRMVSD

SEQ ID NO: 11788 - protein, 14 aa, Mus sp.
VYIFYGASIASLSA

SEQ ID NO: 11789 - protein, 17 aa, Mus sp.
AARDNMFSGSKINYTEN

SEQ ID NO: 11790 - protein, 15 aa, Mus sp.
SIPDYWDPAALPDLG

SEQ ID NO: 11791 - protein, 16 aa, Mus sp.
GAPFDWEGAQASQALL

SEQ ID NO: 11792 - protein, 14 aa, Mus sp.
KDLYYAAPLSIWWQ

SEQ ID NO: 11793 - protein, 16 aa, Mus sp.
GQNAWFLPAQADIVAT

SEQ ID NO: 11794 - protein, 14 aa, Mus sp.
IQEPYTFPAILKSV

SEQ ID NO: 11795 - protein, 16 aa, Mus sp.
DPDFLRTAVAQVIGDR

SEQ ID NO: 11796 - protein, 16 aa, Mus sp.
VPFWAHAGNAIPSADQ

SEQ ID NO: 11797 - protein, 15 aa, Mus sp.
APNLHFHNPNPEIPA

SEQ ID NO: 11798 - protein, 27 aa, Mus sp.
GGLDSLIGDSNFGAPSASVAAAPAPAR

SEQ ID NO: 11799 - protein, 15 aa, Mus sp.
GYTYTASAIKHVITE

SEQ ID NO: 11800 - protein, 18 aa, Mus sp.
EVERRLTSPVINTSLDTK

SEQ ID NO: 11801 - protein, 17 aa, Mus sp.
EAPAAAEAPAAAEAPAA

SEQ ID NO: 11802 - protein, 15 aa, Mus sp.
FPIKWTAPEAALYGR

SEQ ID NO: 11803 - protein, 17 aa, Mus sp.
ATIQWWNMPSPNVDPYD

SEQ ID NO: 11804 - protein, 14 aa, Mus sp.
FGNIYSTPLALQML

SEQ ID NO: 11805 - protein, 14 aa, Mus sp.
RDNMFSGSKINYTE

SEQ ID NO: 11806 - protein, 16 aa, Mus sp.
ATLEIKGPQADLIDAV

SEQ ID NO: 11807 - protein, 17 aa, Mus sp.
EDPDGFSWPATLPSVYK

SEQ ID NO: 11808 - protein, 14 aa, Mus sp.
SNEFDYPSVGQLAH

SEQ ID NO: 11809 - protein, 17 aa, Mus sp.
DPQLSYAVSWAKVSESG

SEQ ID NO: 11810 - protein, 17 aa, Mus sp.
IILENYAYPGVLLIGTD

SEQ ID NO: 11811 - protein, 16 aa, Mus sp.
ATEEKYHEALAKGDVT

SEQ ID NO: 11812 - protein, 16 aa, Mus sp.
YVELPPSVSQAATSPP

SEQ ID NO: 11813 - protein, 11 aa, Mus sp.
FHNPHVNPLPT

SEQ ID NO: 11814 - protein, 25 aa, Mus sp.
KGADKTVKGPDGLTALEATDNQAIK

SEQ ID NO: 11815 - protein, 15 aa, Mus sp.
GEFDYSGSQAIKALK

SEQ ID NO: 11816 - protein, 15 aa, Mus sp.
APYQGPDAAPGALDY

SEQ ID NO: 11817 - protein, 18 aa, Mus sp.
DGDMRLVNGASANEGRVE

SEQ ID NO: 11818 - protein, 19 aa, Mus sp.
TGTTVYRQFWIFDVQNPDD

SEQ ID NO: 11819 - protein, 16 aa, Mus sp.
PMFIVNTNVPRASVPE

SEQ ID NO: 11820 - protein, 15 aa, Mus sp.
AMLQVLGPKPALPEG

SEQ ID NO: 11821 - protein, 15 aa, Mus sp.
VAWATGEPNFANDDE

SEQ ID NO: 11822 - protein, 20 aa, Mus sp.
DEGKLLEAKGPVTDVAYSHD

SEQ ID NO: 11823 - protein, 18 aa, Mus sp.
DGIHHWTPPKGHVDPGEN

SEQ ID NO: 11824 - protein, 27 aa, Mus sp.
GNPTVEVDLYTAKGLFRAAVPSGASTG

SEQ ID NO: 11825 - protein, 20 aa, Mus sp.
HSMRYFETAVSRPGLEEPRY

SEQ ID NO: 11826 - protein, 14 aa, Mus sp.
KQIDYTVPTVIAEE

SEQ ID NO: 11827 - protein, 22 aa, Mus sp.
VDPTPDPNTAYASYPSASVENY

SEQ ID NO: 11828 - protein, 14 aa, Mus sp.
ASFKDPKISTSLPV

SEQ ID NO: 11829 - protein, 18 aa, Mus sp.
LPKEELYMPPLVIKVIDH

SEQ ID NO: 11830 - protein, 18 aa, Mus sp.
GPDFEYVSPIPAWARDDW

SEQ ID NO: 11831 - protein, 15 aa, Mus sp.
KGFYKEATQLWGKAE

SEQ ID NO: 11832 - protein, 18 aa, Mus sp.
SADDFFQGTKAALAGGTT

SEQ ID NO: 11833 - protein, 18 aa, Mus sp.
INRLDNYDAPDIANIAIS

SEQ ID NO: 11834 - protein, 13 aa, Mus sp.
VELPPSVSQAATS

SEQ ID NO: 11835 - protein, 13 aa, Mus sp.
VFDVTAPNTFKTL

SEQ ID NO: 11836 - protein, 14 aa, Mus sp.
GEFDYSGSQAIKAL

SEQ ID NO: 11837 - protein, 16 aa, Mus sp.
LTPWLAPIVSEGTFDP

SEQ ID NO: 11838 - protein, 17 aa, Mus sp.
FGNSEFDPPGPNVATTT

SEQ ID NO: 11839 - protein, 21 aa, Mus sp.
TPSPESPDQWSSSSPHSASDW

SEQ ID NO: 11840 - protein, 15 aa, Mus sp.
AELQTLAPAINWLPF

SEQ ID NO: 11841 - protein, 18 aa, Mus sp.
LQHGSLFLKTPKIVSSKD

SEQ ID NO: 11842 - protein, 17 aa, Mus sp.
SPCANDVALIGFMMKPS

SEQ ID NO: 11843 - protein, 16 aa, Mus sp.
VPSGLFIPSMAIGAIA

SEQ ID NO: 11844 - protein, 15 aa, Mus sp.
AYWEVKYPFPLSNRD

SEQ ID NO: 11845 - protein, 16 aa, Mus sp.
QPPTGYSTPTAPQAYS

SEQ ID NO: 11846 - protein, 16 aa, Mus sp.
GQLPDYTSPVVLPYSR

SEQ ID NO: 11847 - protein, 21 aa, Mus sp.
KPTVTVVSPLPNDSINPQPSP

SEQ ID NO: 11848 - protein, 17 aa, Mus sp.
EFPDNYNSPTPYKIQYN

SEQ ID NO: 11849 - protein, 14 aa, Mus sp.
IKIAWESPQGQVSR

SEQ ID NO: 11850 - protein, 16 aa, Mus sp.
INDYKGAVIVVSHDAR

SEQ ID NO: 11851 - protein, 15 aa, Mus sp.
YDLKWEFPRENLEFG

SEQ ID NO: 11852 - protein, 16 aa, Mus sp.
ITPSYVAFTPEGERLI

SEQ ID NO: 11853 - protein, 12 aa, Mus sp.
APDTRFVAPGAL

SEQ ID NO: 11854 - protein, 18 aa, Listeria monocytogenes
GLLMAKKYKMNLTIVIVN

SEQ ID NO: 11855 - protein, 17 aa, Mus sp.
VPIYEGYALPHAILRLD

SEQ ID NO: 11856 - protein, 18 aa, Mus sp.
SWKTFLKYSEEVLAVFKS

SEQ ID NO: 11857 - protein, 14 aa, BOVIN
SVVVGPSVVAVPLP

SEQ ID NO: 11858 - protein, 24 aa, Mus sp.
LPEEVGEYRQPSGGSVPVSPGPPS

SEQ ID NO: 11859 - protein, 13 aa, Mus sp.
DYFKGAIPIRKLV

SEQ ID NO: 11860 - protein, 26 aa, Mus sp.
GPSAPATPAAEAKAAEAAASAYYNPG

SEQ ID NO: 11861 - protein, 16 aa, Mus sp.
DSVVFAGPAGNSVETR

SEQ ID NO: 11862 - protein, 17 aa, Mus sp.
SYPFDFQGAKIITGQEE

SEQ ID NO: 11863 - protein, 18 aa, Mus sp.
RPGLSYHYAHSHLAEEEG

SEQ ID NO: 11864 - protein, 12 aa, Mus sp.
YTIPFYTPIPNG

SEQ ID NO: 11865 - protein, 15 aa, Mus sp.
LVFDVTAPNTFKTLD

SEQ ID NO: 11866 - protein, 19 aa, Mus sp.
NPGNPHNVYMPTSQPPPPP

SEQ ID NO: 11867 - protein, 20 aa, Mus sp.
DPAGPNFEYAEAPSRLSPDD

SEQ ID NO: 11868 - protein, 15 aa, Mus sp.
KNVTELNEPLSNEER

SEQ ID NO: 11869 - protein, 18 aa, Mus sp.
LQSTDYGNFLANEASPLT

SEQ ID NO: 11870 - protein, 27 aa, Mus sp.
VPPAGGGDPEAPAPAPAAERPPAPGPG

SEQ ID NO: 11871 - protein, 19 aa, Mus sp.
KEDRRYNPPIIHQGFQDTS

SEQ ID NO: 11872 - protein, 26 aa, Mus sp.
NPTVEVDLYTAKGLFRAAVPSGASTG

SEQ ID NO: 11873 - protein, 17 aa, Mus sp.
SGPKPFSAPKPQTSPSP

SEQ ID NO: 11874 - protein, 15 aa, Mus sp.
SKEAFQEALAAAGDK

SEQ ID NO: 11875 - protein, 15 aa, Mus sp.
SLFLKTPKIVSSKDY

SEQ ID NO: 11876 - protein, 13 aa, Mus sp.
ELDYYDSPSVNAR

SEQ ID NO: 11877 - protein, 20 aa, Mus sp.
GKLTGMAFRVPTPNVSVVDL

SEQ ID NO: 11878 - protein, 19 aa, Mus sp.
SPGILQASPTPLLAAAAPA

SEQ ID NO: 11879 - protein, 17 aa, Mus sp.
SMPDYKPSFPKWARQDF

SEQ ID NO: 11880 - protein, 15 aa, Mus sp.
IGRTWNDPSVQQDIK

SEQ ID NO: 11881 - protein, 16 aa, Mus sp.
SYPFDFQGAKIITGQE

SEQ ID NO: 11882 - protein, 17 aa, Mus sp.
GGPGSAVSPYPSFNVSS

SEQ ID NO: 11883 - protein, 14 aa, Mus sp.
KDGYQMAQPVFAPK

SEQ ID NO: 11884 - protein, 16 aa, Mus sp.
SPHPYQLPQALAPHVD

SEQ ID NO: 11885 - protein, 16 aa, Mus sp.
EEWGPFKAPHANRFIF

SEQ ID NO: 11886 - protein, 16 aa, Mus sp.
VRLVSQEPKALVSEWK

SEQ ID NO: 11887 - protein, 20 aa, Mus sp.
VQIPKVVKSPSSLPAKPLVP

SEQ ID NO: 11888 - protein, 17 aa, Mus sp.
GNNCKNGGACVDGVNTY

SEQ ID NO: 11889 - protein, 18 aa, Mus sp.
CASLLRARLLLQLAQSQQ

SEQ ID NO: 11890 - protein, 17 aa, Mus sp.
FVLPANAFASPLQNPDN

SEQ ID NO: 11891 - protein, 27 aa, Mus sp.
DDIEADHVGTYGISVYQSPGDIGQYTF

SEQ ID NO: 11892 - protein, 14 aa, Mus sp.
SNSYGIPEPAHAYA

SEQ ID NO: 11893 - protein, 25 aa, Mus sp.
TPARAPETRSQVTPSVPSEALDDST

SEQ ID NO: 11894 - protein, 18 aa, Mus sp.
NGKTELNYKNTEPVLDSD

SEQ ID NO: 11895 - protein, 19 aa, Mus sp.
TPDPNTAYASYPSASVENY

SEQ ID NO: 11896 - protein, 18 aa, Mus sp.
SAVKSKYKASIAALEAKI

SEQ ID NO: 11897 - protein, 16 aa, Mus sp.
RVSSWDVPTVVPVPFE

SEQ ID NO: 11898 - protein, 17 aa, Mus sp.
TRSQVTPSVPSEALDDS

SEQ ID NO: 11899 - protein, 15 aa, Mus sp.
RDGDSYRSPWSNKYD

SEQ ID NO: 11900 - protein, 21 aa, Mus sp.
TPSPTPENEDLHAATVNPDPS

SEQ ID NO: 11901 - protein, 13 aa, Mus sp.
ITWTWQGPGALKI

SEQ ID NO: 11902 - protein, 13 aa, Mus sp.
INYQPPTVVPGGD

SEQ ID NO: 11903 - protein, 15 aa, Mus sp.
YPFDFQGAKIITGQE

SEQ ID NO: 11904 - protein, 12 aa, Mus sp.
AGWFDQIAVKVA

SEQ ID NO: 11905 - protein, 16 aa, Mus sp.
DFSTFLSPNVLEEVDS

SEQ ID NO: 11906 - protein, 21 aa, Mus sp.
APETRSQVTPSVPSEALDDST

SEQ ID NO: 11907 - protein, 18 aa, Mus sp.
VPSVIYTHPEVAWVGKSE

SEQ ID NO: 11908 - protein, 14 aa, Mus sp.
WSDAAAPFAGLSTD

SEQ ID NO: 11909 - protein, 17 aa, Mus sp.
ERFGVRFPAMSDAYDRD

SEQ ID NO: 11910 - protein, 17 aa, Mus sp.
TPVFVHAGPFANIAHGN

SEQ ID NO: 11911 - protein, 25 aa, Mus sp.
KDESGFPKPPSYNVATTLPSYDEAE

SEQ ID NO: 11912 - protein, 15 aa, Mus sp.
VATNPIITPVAQENQ

SEQ ID NO: 11913 - protein, 18 aa, Mus sp.
SSSIASFKDPKISTSLPV

SEQ ID NO: 11914 - protein, 27 aa, Mus sp.
VIPELNGKLTGMAFRVPTPNVSVVDLT

SEQ ID NO: 11915 - protein, 13 aa, Mus sp.
GDSERHFVYQFMG

SEQ ID NO: 11916 - protein, 20 aa, Mus sp.
AGCEEAKLEIMEFVNFLKNP

SEQ ID NO: 11917 - protein, 15 aa, Mus sp.
GYKPFQNPVPNQSPS

SEQ ID NO: 11918 - protein, 19 aa, Mus sp.
GLSGAEGARGPPGFKGHTG

SEQ ID NO: 11919 - protein, 13 aa, Mus sp.
DAFVLKTPSAAYL

SEQ ID NO: 11920 - protein, 16 aa, Mus sp.
DGNHTLFHNPHVNPLP

SEQ ID NO: 11921 - protein, 29 aa, Mus sp.
GGLDSLIGDSNFGAPSASVAAAPAPARLG

SEQ ID NO: 11922 - protein, 18 aa, Mus sp.
TPAAPTSALGPKASPAPS

SEQ ID NO: 11923 - protein, 15 aa, Mus sp.
LEDFYGSPIPSVSLK

SEQ ID NO: 11924 - protein, 15 aa, Mus sp.
ESEEEYSAPLPTPAP

SEQ ID NO: 11925 - protein, 15 aa, Mus sp.
KPPSYNVATTLPSYD

SEQ ID NO: 11926 - protein, 19 aa, Mus sp.
LPQEKYVTSAPMPEPGAPG

SEQ ID NO: 11927 - protein, 15 aa, Mus sp.
MAPYQGPDAAPGALD

SEQ ID NO: 11928 - protein, 16 aa, Mus sp.
IMLLYNGPKVNLVIIK

SEQ ID NO: 11929 - protein, 17 aa, Mus sp.
ARDNMFSGSKINYTENR

SEQ ID NO: 11930 - protein, 15 aa, Mus sp.
GIPVYRFVLPANAFA

SEQ ID NO: 11931 - protein, 15 aa, Mus sp.
WSDAAAPFAGLSTDQ

SEQ ID NO: 11932 - protein, 20 aa, Mus sp.
KLYFHGVFRQRIEMLLSAQT

SEQ ID NO: 11933 - protein, 18 aa, Mus sp.
SGPKPFSAPKPQTSPSPK

SEQ ID NO: 11934 - protein, 14 aa, Mus sp.
VDFDFAGPAIHGSA

SEQ ID NO: 11935 - protein, 15 aa, Mus sp.
FPIKWTAPEAINFGS

SEQ ID NO: 11936 - protein, 17 aa, Mus sp.
KKELEEQLGPVAEETRA

SEQ ID NO: 11937 - protein, 19 aa, Mus sp.
APSEERVYMVGKANSVFED

SEQ ID NO: 11938 - protein, 20 aa, Mus sp.
SPTSPSYSPTSPNYSPTSPS

SEQ ID NO: 11939 - protein, 15 aa, Mus sp.
VTYEWAPPVQNQALA

SEQ ID NO: 11940 - protein, 20 aa, Mus sp.
YPPSGPTYRGPVPWHTINLD

SEQ ID NO: 11941 - protein, 22 aa, Mus sp.
LPEEVGEYRQPSGGSVPVSPGP

SEQ ID NO: 11942 - protein, 19 aa, BOVIN
GPPVASVVVGPSVVAVPLP

SEQ ID NO: 11943 - protein, 16 aa, Mus sp.
SALEYGMPVTLIGEAV

SEQ ID NO: 11944 - protein, 16 aa, Mus sp.
APTTAYKKTTPIEAAS

SEQ ID NO: 11945 - protein, 16 aa, Mus sp.
DTIEFRGPNGLLVYQG

SEQ ID NO: 11946 - protein, 16 aa, Mus sp.
TIEFRGPNGLLVYQGK

SEQ ID NO: 11947 - protein, 12 aa, Mus sp.
GAWTGPMGNWAM

SEQ ID NO: 11948 - protein, 16 aa, Mus sp.
VYIFYGASIASLSASH

SEQ ID NO: 11949 - protein, 13 aa, Mus sp.
APGGYVAPKAVWL

SEQ ID NO: 11950 - protein, 15 aa, Mus sp.
VDFDFAGPAIHGSAV

SEQ ID NO: 11951 - protein, 15 aa, Mus sp.
EVQWQSAEPGSTPRK

SEQ ID NO: 11952 - protein, 17 aa, Mus sp.
MYQMYGGPVVLVAHSMG

SEQ ID NO: 11953 - protein, 18 aa, Mus sp.
EAIETIVAAMSNLVPPVE

SEQ ID NO: 11954 - protein, 16 aa, Mus sp.
AAEEFKVPAATSAIIT

SEQ ID NO: 11955 - protein, 16 aa, Mus sp.
TPESFLGPNAALVDLD

SEQ ID NO: 11956 - protein, 15 aa, Mus sp.
SLVQTYVGAISNGSL

SEQ ID NO: 11957 - protein, 16 aa, Mus sp.
LVFDVTAPNTFKTLDS

SEQ ID NO: 11958 - protein, 16 aa, Listeria monocytogenes
KEKVVATPVSNVSTSS

SEQ ID NO: 11959 - protein, 16 aa, Mus sp.
DGIEDFVSGVPRAART

SEQ ID NO: 11960 - protein, 15 aa, Mus sp.
FGPYYTEPVIAGLDP

SEQ ID NO: 11961 - protein, 13 aa, Mus sp.
FPIKWTAPEAINF

SEQ ID NO: 11962 - protein, 14 aa, Listeria monocytogenes
IAVTAFAAPTIASA

SEQ ID NO: 11963 - protein, 17 aa, Mus sp.
APPLPIKTPIPTPSTLP

SEQ ID NO: 11964 - protein, 14 aa, Mus sp.
SVFVAPAVTPVKGV

SEQ ID NO: 11965 - protein, 18 aa, Mus sp.
DFVAWATGEPNFANDDEN

SEQ ID NO: 11966 - protein, 18 aa, Mus sp.
RPVQFPYVTPAPHEPVKT

SEQ ID NO: 11967 - protein, 16 aa, Mus sp.
VPSVIYTHPEVAWVGK

SEQ ID NO: 11968 - protein, 14 aa, Mus sp.
LPPYDDATAVPSTA

SEQ ID NO: 11969 - protein, 14 aa, Mus sp.
ISNYGFPRSVQAID

SEQ ID NO: 11970 - protein, 16 aa, Mus sp.
DGDSVVFAGPAGNSVE

SEQ ID NO: 11971 - protein, 18 aa, Mus sp.
DGLNLDWQYPGSRGSPPK

SEQ ID NO: 11972 - protein, 18 aa, Mus sp.
IESKEAFQEALAAAGDKL

SEQ ID NO: 11973 - protein, 16 aa, Mus sp.
LDDPIWRGPLPSNGVM

SEQ ID NO: 11974 - protein, 14 aa, Mus sp.
SIASFKDPKISTSL

SEQ ID NO: 11975 - protein, 16 aa, Mus sp.
IPITYPTTAPEIAVPE

SEQ ID NO: 11976 - protein, 19 aa, Mus sp.
DGELTYENVQVSPVPGGPP

SEQ ID NO: 11977 - protein, 17 aa, Mus sp.
IDWTYRPPSSSRTESIF

SEQ ID NO: 11978 - protein, 20 aa, Mus sp.
LIGRTWNDPSVQQDIKFLPF

SEQ ID NO: 11979 - protein, 17 aa, Listeria monocytogenes
TTVKFTLPTVAPAFENT

SEQ ID NO: 11980 - protein, 16 aa, BOVIN
SVVVGPSVVAVPLPLH

SEQ ID NO: 11981 - protein, 16 aa, Mus sp.
VPVPGSPFPLEAVAPT

SEQ ID NO: 11982 - protein, 14 aa, Mus sp.
DHVDFSQPEPHTVL

SEQ ID NO: 11983 - protein, 19 aa, Mus sp.
FEDYVELPPSVSQAAKSPP

SEQ ID NO: 11984 - protein, 17 aa, Mus sp.
GVPTVPLLPPQVNQSLA

SEQ ID NO: 11985 - protein, 16 aa, Mus sp.
SDPKPYSPKLSVIPTS

SEQ ID NO: 11986 - protein, 14 aa, Mus sp.
FPIKWTAPEAINFG

SEQ ID NO: 11987 - protein, 16 aa, Mus sp.
DLPTTFQGATASTSYG

SEQ ID NO: 11988 - protein, 15 aa, Mus sp.
EDVIAEPEGTHSFDG

SEQ ID NO: 11989 - protein, 18 aa, Mus sp.
DGVPVPGSPFPLEAVAPT

SEQ ID NO: 11990 - protein, 13 aa, Mus sp.
DNMFSGSKINYTE

SEQ ID NO: 11991 - protein, 14 aa, Mus sp.
GYKPFQNPVPNQSP

SEQ ID NO: 11992 - protein, 20 aa, Mus sp.
RKGEQIYYAGPVNNPGLDVP

SEQ ID NO: 11993 - protein, 16 aa, Mus sp.
RDLKWGTPVPLEGFED

SEQ ID NO: 11994 - protein, 16 aa, Listeria monocytogenes
GGINQAYTGSTALSDG

SEQ ID NO: 11995 - protein, 17 aa, Mus sp.
IGGDPFAAPQVVPAFAS

SEQ ID NO: 11996 - protein, 17 aa, Mus sp.
IEEIEVAPPKAHEVRIK

SEQ ID NO: 11997 - protein, 14 aa, Mus sp.
EMYKVHNPVPLIVG

SEQ ID NO: 11998 - protein, 18 aa, Mus sp.
SIASFKDPKISTSLPVLD

SEQ ID NO: 11999 - protein, 15 aa, Mus sp.
FSYAVFGPRVASGDL

SEQ ID NO: 12000 - protein, 20 aa, Mus sp.
KIQASVATNPIITPVAQENQ

SEQ ID NO: 12001 - protein, 15 aa, Mus sp.
DLLYSFPVVIKNKTW

SEQ ID NO: 12002 - protein, 17 aa, Mus sp.
VFDVTAPNTFKTLDSWR

SEQ ID NO: 12003 - protein, 14 aa, Mus sp.
EVYHEPHIADAWPQ

SEQ ID NO: 12004 - protein, 16 aa, Mus sp.
NVTELNEPLSNEERNL

SEQ ID NO: 12005 - protein, 15 aa, Mus sp.
YYNEVHSPSVAVEMG

SEQ ID NO: 12006 - protein, 16 aa, Mus sp.
LITGVDFIGSTVGLAK

SEQ ID NO: 12007 - protein, 24 aa, Mus sp.
IQEMEKEDRRYNPPIIHQGFQDTS

SEQ ID NO: 12008 - protein, 16 aa, Mus sp.
DSGGFYISPRSTFSSL

SEQ ID NO: 12009 - protein, 16 aa, Mus sp.
TETQEKNPLPSKETIE

SEQ ID NO: 12010 - protein, 18 aa, Mus sp.
APAPAAAPAAAPAAAPEP

SEQ ID NO: 12011 - protein, 16 aa, Mus sp.
DSENMEREAETVDLDD

SEQ ID NO: 12012 - protein, 22 aa, Mus sp.
NDQGNRITPSYVAFTPEGERLI

SEQ ID NO: 12013 - protein, 15 aa, Mus sp.
DVPFTLAPHVLAAQG

SEQ ID NO: 12014 - protein, 16 aa, Mus sp.
DPNTAYASYPSASVEN

SEQ ID NO: 12015 - protein, 12 aa, Mus sp.
VDFDFAGPAIHG

SEQ ID NO: 12016 - protein, 21 aa, Mus sp.
EMEKEDRRYNPPIIHQGFQDT

SEQ ID NO: 12017 - protein, 25 aa, Mus sp.
LPNKPTVTVVSPLPNDSINPQPSPD

SEQ ID NO: 12018 - protein, 19 aa, Mus sp.
GFPKPPSYNVATTLPSYDE

SEQ ID NO: 12019 - protein, 20 aa, Mus sp.
YPNPTLDHYKEPSAIFQLPY

SEQ ID NO: 12020 - protein, 14 aa, Mus sp.
VATNPIITPVAQEN

SEQ ID NO: 12021 - protein, 16 aa, Mus sp.
TVTPWKAPIVWEGTYD

SEQ ID NO: 12022 - protein, 15 aa, Mus sp.
DTIEFRGPNGLLVYQ

SEQ ID NO: 12023 - protein, 15 aa, Mus sp.
IDPYDQPNAIYIERH

SEQ ID NO: 12024 - protein, 18 aa, Mus sp.
GRIEHLYKNPQAHIEGNM

SEQ ID NO: 12025 - protein, 15 aa, Mus sp.
DLDIFNLPNVEISKD

SEQ ID NO: 12026 - protein, 20 aa, Mus sp.
GQDHVDFSQPEPHTVLFHEP

SEQ ID NO: 12027 - protein, 15 aa, Mus sp.
RDYVPPTANLDQKDK

SEQ ID NO: 12028 - protein, 17 aa, Mus sp.
DEAQVEFMASHGNEAAR

SEQ ID NO: 12029 - protein, 16 aa, Mus sp.
YYLPYKSPGINVDSSY

SEQ ID NO: 12030 - protein, 13 aa, Mus sp.
KLPFAAAQIGNSF

SEQ ID NO: 12031 - protein, 18 aa, Mus sp.
ADGREVSSVEAPSVSPAR

SEQ ID NO: 12032 - protein, 20 aa, Mus sp.
HPPQEATNSPKPQPSYEELE

SEQ ID NO: 12033 - protein, 16 aa, Mus sp.
VPLPGMKWVDNHKGVF

SEQ ID NO: 12034 - protein, 18 aa, Mus sp.
IGDTIEFRGPNGLLVYQG

SEQ ID NO: 12035 - protein, 23 aa, Mus sp.
VDPTPDPNTAYASYPSASVENYQ

SEQ ID NO: 12036 - protein, 21 aa, Mus sp.
SNKIPEVDMARVVAPFMSNIP

SEQ ID NO: 12037 - protein, 16 aa, Mus sp.
EDKVYWTDVINEAIFS

SEQ ID NO: 12038 - protein, 16 aa, Mus sp.
KPSQAGWFDQIAVKVA

SEQ ID NO: 12039 - protein, 17 aa, Mus sp.
EPSKYYYEVSLPSGLEE

SEQ ID NO: 12040 - protein, 15 aa, Mus sp.
DNMFSGSKINYTENR

SEQ ID NO: 12041 - protein, 22 aa, Mus sp.
DYNRDGDSYRSPWSNKYDPPLE

SEQ ID NO: 12042 - protein, 16 aa, Mus sp.
APPHFHFGQTNRTPEF

SEQ ID NO: 12043 - protein, 12 aa, Mus sp.
GKKFTAPHILIA

SEQ ID NO: 12044 - protein, 17 aa, Mus sp.
DERFGVRFPAMSDAYDR

SEQ ID NO: 12045 - protein, 19 aa, Mus sp.
DVKKPAAAPAPAPAPAPAP

SEQ ID NO: 12046 - protein, 16 aa, Mus sp.
WKFTITPPSAQVVGVL

SEQ ID NO: 12047 - protein, 17 aa, Mus sp.
RPDAEYWNSQPEILERT

SEQ ID NO: 12048 - protein, 14 aa, Mus sp.
TSIEYVTQRNCNLT

SEQ ID NO: 12049 - protein, 18 aa, Mus sp.
GRRTDWEAPTGQPSAPGP

SEQ ID NO: 12050 - protein, 21 aa, Mus sp.
LNGKLTGMAFRVPTPNVSVVD

SEQ ID NO: 12051 - protein, 15 aa, Mus sp.
GAPFDWEGAQASQAL

SEQ ID NO: 12052 - protein, 15 aa, Mus sp.
IPISKVKDVYVITDQ

SEQ ID NO: 12053 - protein, 17 aa, Mus sp.
RITPSYVAFTPEGERLI

SEQ ID NO: 12054 - protein, 16 aa, Mus sp.
VDMARVVAPFMSNIPL

SEQ ID NO: 12055 - protein, 21 aa, Mus sp.
GEMDEATRYLAPTILTDVDPN

SEQ ID NO: 12056 - protein, 16 aa, Mus sp.
DPWTAWNAPKPGNWDS

SEQ ID NO: 12057 - protein, 17 aa, Mus sp.
DPAEYDVSPETRRAQVE

SEQ ID NO: 12058 - protein, 13 aa, Mus sp.
GGHKLGLGLEFQA

SEQ ID NO: 12059 - protein, 15 aa, Mus sp.
TGVDFIGSTVGLAKV

SEQ ID NO: 12060 - protein, 15 aa, Mus sp.
TPAYTIPFYTPIPNG

SEQ ID NO: 12061 - protein, 16 aa, Mus sp.
IEGYVPSQADVAVFEA

SEQ ID NO: 12062 - protein, 24 aa, Mus sp.
YVDPTPDPNTAYASYPSASVENYQ

SEQ ID NO: 12063 - protein, 17 aa, Mus sp.
SLESFLGPRANTEDLPF

SEQ ID NO: 12064 - protein, 19 aa, Mus sp.
SEPTTLFKTASALRSSAPL

SEQ ID NO: 12065 - protein, 18 aa, Mus sp.
RLYKKAYNDHKAKISIPV

SEQ ID NO: 12066 - protein, 16 aa, Mus sp.
EVSSVEAPSVSPARHQ

SEQ ID NO: 12067 - protein, 13 aa, Mus sp.
GYVPSQADVAVFE

SEQ ID NO: 12068 - protein, 15 aa, Mus sp.
TVIHFNNPKVQASLS

SEQ ID NO: 12069 - protein, 15 aa, Mus sp.
NYEYYASHVPESVKN

SEQ ID NO: 12070 - protein, 17 aa, Mus sp.
EDRRYNPPIIHQGFQDT

SEQ ID NO: 12071 - protein, 16 aa, Mus sp.
AVLEQEPIVLPAWDPM

SEQ ID NO: 12072 - protein, 16 aa, Mus sp.
DFVAWATGEPNFANDD

SEQ ID NO: 12073 - protein, 15 aa, Mus sp.
GDFYYHAAIFGGTPT

SEQ ID NO: 12074 - protein, 15 aa, Mus sp.
GEVEWKGPWSDSSYE

SEQ ID NO: 12075 - protein, 14 aa, Mus sp.
NSVFVAPAVTPVKG

SEQ ID NO: 12076 - protein, 17 aa, Mus sp.
VLDNYLTSPLPEEVDET

SEQ ID NO: 12077 - protein, 17 aa, Mus sp.
AKQIVWNGPVGVFEWEA

SEQ ID NO: 12078 - protein, 16 aa, Mus sp.
VPTDKYYGAQTVRSTM

SEQ ID NO: 12079 - protein, 17 aa, Mus sp.
EQIYYAGPVNNPGLDVP

SEQ ID NO: 12080 - protein, 17 aa, Mus sp.
ARPDDEVGPAVAPGHPL

SEQ ID NO: 12081 - protein, 18 aa, Mus sp.
VQIPKVVKSPSSLPAKPL

SEQ ID NO: 12082 - protein, 16 aa, Mus sp.
GALLLNAPVVSITQGR

SEQ ID NO: 12083 - protein, 16 aa, Mus sp.
LGFPYEGPAPLEAIAN

SEQ ID NO: 12084 - protein, 17 aa, Mus sp.
EDGELTYENVQVSPVPG

SEQ ID NO: 12085 - protein, 13 aa, Mus sp.
FDIFYTAPQPGKY

SEQ ID NO: 12086 - protein, 15 aa, Mus sp.
VADKEFHAPLIIDEN

SEQ ID NO: 12087 - protein, 13 aa, Mus sp.
VAYEAPSLATGYG

SEQ ID NO: 12088 - protein, 13 aa, Mus sp.
YVTQFHPPHIEIQ

SEQ ID NO: 12089 - protein, 15 aa, Mus sp.
LPQDPTFHTPLDLYA

SEQ ID NO: 12090 - protein, 17 aa, Mus sp.
YTWSDAAAPFAGLSTDQ

SEQ ID NO: 12091 - protein, 14 aa, Mus sp.
ALPYDTPVPGYMNN

SEQ ID NO: 12092 - protein, 14 aa, Mus sp.
TAYASYPSASVENY

SEQ ID NO: 12093 - protein, 15 aa, Mus sp.
FEVQWQSAEPGSTPR

SEQ ID NO: 12094 - protein, 27 aa, Mus sp.
KVIPELNGKLTGMAFRVPTPNVSVVDL

SEQ ID NO: 12095 - protein, 17 aa, Mus sp.
NPGDGAFYGPKIDIQIK

SEQ ID NO: 12096 - protein, 18 aa, Mus sp.
EDYVELPPSVSQAAKSPP

SEQ ID NO: 12097 - protein, 18 aa, Mus sp.
YKKELEEQLGPVAEETRA

SEQ ID NO: 12098 - protein, 14 aa, Mus sp.
SKTVYALPTIAFAF

SEQ ID NO: 12099 - protein, 14 aa, Mus sp.
DSKIVVPPLPGKAL

SEQ ID NO: 12100 - protein, 30 aa, Mus sp.; identical to SEQ ID NO: 2540

SEQ ID NO: 12101 - protein, 22 aa, Mus sp.
GPNIGGDTHFDSAEPWTVQNED

SEQ ID NO: 12102 - protein, 15 aa, Mus sp.
SLQAFSNPSAGISVD

SEQ ID NO: 12103 - protein, 16 aa, Mus sp.
TGMAFRVPTPNVSVVD

SEQ ID NO: 12104 - protein, 17 aa, Mus sp.
IDLKGIPVYRFVLPANA

SEQ ID NO: 12105 - protein, 16 aa, Mus sp.
NQLEALVGPEANVGPY

SEQ ID NO: 12106 - protein, 14 aa, Mus sp.
TNDQNQNGNHTLPQ

SEQ ID NO: 12107 - protein, 18 aa, Mus sp.
GIDPYDQPNAIYIERHEP

SEQ ID NO: 12108 - protein, 14 aa, Mus sp.
SSIASFKDPKISTS

SEQ ID NO: 12109 - protein, 18 aa, Mus sp.
GPLDQVRAALPTPALTPE

SEQ ID NO: 12110 - protein, 15 aa, Mus sp.
ADKTVKGPDGLTALE

SEQ ID NO: 12111 - protein, 17 aa, Mus sp.
EVSSVEAPSVSPARHQL

SEQ ID NO: 12112 - protein, 16 aa, Mus sp.
DHVDFSQPEPHTVLFH

SEQ ID NO: 12113 - protein, 14 aa, Mus sp.
IDPYDQPNAIYIER

SEQ ID NO: 12114 - protein, 18 aa, Mus sp.
EPPSDLDFFSPRPVPAAS

SEQ ID NO: 12115 - protein, 19 aa, Mus sp.
SELERESKVVVPPLPGKAF

SEQ ID NO: 12116 - protein, 21 aa, Mus sp.
YPTPAYTIPFYTPIPNGLYPS

SEQ ID NO: 12117 - protein, 15 aa, Mus sp.
YQMYGGPVVLVAHSM

SEQ ID NO: 12118 - protein, 14 aa, Mus sp.
ASPVFRAPGLTAVA

SEQ ID NO: 12119 - protein, 14 aa, Mus sp.
ITWTWQGPGALKIL

SEQ ID NO: 12120 - protein, 16 aa, Mus sp.
FSPYAAPSPQGSYQPS

SEQ ID NO: 12121 - protein, 15 aa, Mus sp.
GNSEFDPPGPNVATT

SEQ ID NO: 12122 - protein, 15 aa, Mus sp.
DKQREEYQPATPGLG

SEQ ID NO: 12123 - protein, 10 aa, Mus sp.
LWPWPQYIQT

SEQ ID NO: 12124 - protein, 17 aa, Mus sp.
YPFDFQGAKIITGQEEG

SEQ ID NO: 12125 - protein, 16 aa, Mus sp.
FVEEFIWPAVQSSALY

SEQ ID NO: 12126 - protein, 16 aa, Mus sp.
VPNYKLITPAVVSERL

SEQ ID NO: 12127 - protein, 13 aa, Mus sp.
DPAWEAPEGVPID

SEQ ID NO: 12128 - protein, 14 aa, Mus sp.
RLDNYDAPDIANIA

SEQ ID NO: 12129 - protein, 13 aa, Mus sp.
VTYEWAPPVQNQA

SEQ ID NO: 12130 - protein, 16 aa, Mus sp.
YAVDIRSPAISWVNNL

SEQ ID NO: 12131 - protein, 19 aa, Listeria monocytogenes
SNVNHVLDIGYGGGSNVKN

SEQ ID NO: 12132 - protein, 16 aa, Mus sp.
WQKIQEPYTFPAILKS

SEQ ID NO: 12133 - protein, 12 aa, Mus sp.
YLPYKSPGINVD

SEQ ID NO: 12134 - protein, 16 aa, Mus sp.
NPPSYYTQPVPVPNAN

SEQ ID NO: 12135 - protein, 18 aa, Mus sp.
YPPSGPTYRGPVPWHTIN

SEQ ID NO: 12136 - protein, 16 aa, Mus sp.
TDKFWGPSGAESVIGG

SEQ ID NO: 12137 - protein, 8 aa, Mus sp.
ATLVFHNL

SEQ ID NO: 12138 - protein, 21 aa, Mus sp.
GDSVTTDHISPAGNIARNSPA

SEQ ID NO: 12139 - protein, 13 aa, Mus sp.
DGYQMAQPVFAPK

SEQ ID NO: 12140 - protein, 16 aa, Mus sp.
WHIQADHAYQALPSFQ

SEQ ID NO: 12141 - protein, 15 aa, Mus sp.
KGQDHVDFSQPEPHT

SEQ ID NO: 12142 - protein, 17 aa, Mus sp.
LAPMYYRGAQAAIVVYD

SEQ ID NO: 12143 - protein, 17 aa, Mus sp.
DKEKVIVDFSSPNIAKE

SEQ ID NO: 12144 - protein, 25 aa, Mus sp.
ITGLDPAGPNFEYAEAPSRLSPDDA

SEQ ID NO: 12145 - protein, 16 aa, Mus sp.
GIFTFEEPVTHVSESI

SEQ ID NO: 12146 - protein, 15 aa, Mus sp.
KQIDYTVPTVIAEEM

SEQ ID NO: 12147 - protein, 17 aa, Mus sp.
MKIYYFAAVAHLHMGKQ

SEQ ID NO: 12148 - protein, 16 aa, Mus sp.
LDQLFSGPLPGRLPVN

SEQ ID NO: 12149 - protein, 21 aa, Mus sp.
EEKPVPAAPVPSPVAPAPVPS

SEQ ID NO: 12150 - protein, 16 aa, Mus sp.
GDSYRSPWSNKYDPPL

SEQ ID NO: 12151 - protein, 17 aa, Mus sp.
DLVDAVTPSPQPSKEED

SEQ ID NO: 12152 - protein, 16 aa, Mus sp.
LPFGAYTNPFATPAQA

SEQ ID NO: 12153 - protein, 15 aa, Mus sp.
EDYVELPPSVSQAAK

SEQ ID NO: 12154 - protein, 19 aa, Mus sp.
DDGTVIHFNNPKVQASLSA

SEQ ID NO: 12155 - protein, 17 aa, Mus sp.
TPAAPTSALGPKASPAP

SEQ ID NO: 12156 - protein, 13 aa, Mus sp.
GVELYRAPFPLYA

SEQ ID NO: 12157 - protein, 18 aa, Mus sp.
DPAKGRIYQGTEADSIFS

SEQ ID NO: 12158 - protein, 16 aa, Mus sp.
FELPYVSVTSLRSQEY

SEQ ID NO: 12159 - protein, 14 aa, Mus sp.
VNWYAPLVAPISKD

SEQ ID NO: 12160 - protein, 14 aa, Mus sp.
LPNVQVEGPTPNRP

SEQ ID NO: 12161 - protein, 16 aa, Mus sp.
SNLLLQSPGVLTAARE

SEQ ID NO: 12162 - protein, 15 aa, Mus sp.
GNVYIHPTAKVAPSA

SEQ ID NO: 12163 - protein, 18 aa, Mus sp.
AGPQWADPQISESNFSPK

SEQ ID NO: 12164 - protein, 14 aa, Mus sp.
ADKEFHAPLIIDEN

SEQ ID NO: 12165 - protein, 16 aa, Mus sp.
IDNPDYKGTWIHPEID

SEQ ID NO: 12166 - protein, 20 aa, Mus sp.
DGHGGYKPFQNPVPNQSPSS

SEQ ID NO: 12167 - protein, 15 aa, Mus sp.
GVNEYGLPMAVAQVL

SEQ ID NO: 12168 - protein, 14 aa, Mus sp.
VQIYHNPTANSFRV

SEQ ID NO: 12169 - protein, 11 aa, Mus sp.
AEYWNSQPEIL

SEQ ID NO: 12170 - protein, 13 aa, Mus sp.
VPSRDYAYSIING

SEQ ID NO: 12171 - protein, 17 aa, Mus sp.
NPTDAYLDAMMNEAPGP

SEQ ID NO: 12172 - protein, 16 aa, Mus sp.
GPKPFSAPKPQTSPSP

SEQ ID NO: 12173 - protein, 18 aa, Mus sp.
SPTGNIFFSPFSISSALA

SEQ ID NO: 12174 - protein, 12 aa, Mus sp.
RLNSPVTIPAVM

SEQ ID NO: 12175 - protein, 24 aa, Mus sp.
VPDGPEAPLDELVGAYPNYNEEEE

SEQ ID NO: 12176 - protein, 16 aa, Mus sp.
LTTSSYSNPTIGYENR

SEQ ID NO: 12177 - protein, 23 aa, Mus sp.
YPPPYPPAAFQGPSDHAAYPIPQ

SEQ ID NO: 12178 - protein, 13 aa, Mus sp.
HDLDFRAPHVLVL

SEQ ID NO: 12179 - protein, 16 aa, Mus sp.
LPPHVYSTPQPSLPPV

SEQ ID NO: 12180 - protein, 16 aa, Mus sp.
GTPDYISPEVLKSQGG

SEQ ID NO: 12181 - protein, 16 aa, Mus sp.
APPLPIKTPIPTPSTL

SEQ ID NO: 12182 - protein, 15 aa, Mus sp.
HDLDFRAPHVLVLGS

SEQ ID NO: 12183 - protein, 20 aa, Mus sp.
EDGELTYENVQVSPVPGGPP

SEQ ID NO: 12184 - protein, 14 aa, Mus sp.
ALMYNTPRAATIIA

SEQ ID NO: 12185 - protein, 20 aa, Mus sp.
KNKPEDYQGGRTGEAIVDAA

SEQ ID NO: 12186 - protein, 17 aa, Mus sp.
GGSPYIAAKINEAKDLL

SEQ ID NO: 12187 - protein, 17 aa, Mus sp.
VGGERFEAPEALFQPHL

SEQ ID NO: 12188 - protein, 15 aa, Mus sp.
NQLEALVGPEANVGP

SEQ ID NO: 12189 - protein, 26 aa, Mus sp.
VDPTPDPNTAYASYPSASVENYQQPP

SEQ ID NO: 12190 - protein, 17 aa, Mus sp.
IGVGAYVSPDMMVAEYS

SEQ ID NO: 12191 - protein, 26 aa, Mus sp.
GNPTVEVDLYTAKGLFRAAVPSGAST

SEQ ID NO: 12192 - protein, 17 aa, Mus sp.
IIEQSWGSPKVTKDGVT

SEQ ID NO: 12193 - protein, 15 aa, Mus sp.
VDFDIAGPSIRGALV

SEQ ID NO: 12194 - protein, 17 aa, Mus sp.
LSRWEQEQIRKGINIPQ

SEQ ID NO: 12195 - protein, 16 aa, Mus sp.
VDHRGTWNGPWVSTEV

SEQ ID NO: 12196 - protein, 17 aa, Mus sp.
KIPPDVLQDMAVIAPML

SEQ ID NO: 12197 - protein, 21 aa, Mus sp.
EPPPPRSHYSNIEANESEEVR

SEQ ID NO: 12198 - protein, 18 aa, Mus sp.
RSLQAFSNPSAGISVDVK

SEQ ID NO: 12199 - protein, 24 aa, Mus sp.
YTAKGLFRAAVPSGASTGIYEALE

SEQ ID NO: 12200 - protein, 20 aa, Mus sp.
EPPQVPAEAPQPRASEDSPR

SEQ ID NO: 12201 - protein, 15 aa, Mus sp.
DSPDVVYSPETIEAR

SEQ ID NO: 12202 - protein, 15 aa, Mus sp.
VSSYTPPQPSYSQPP

SEQ ID NO: 12203 - protein, 17 aa, Mus sp.
DLGSDIFAAPAPQSTAT

SEQ ID NO: 12204 - protein, 14 aa, Mus sp.
FPIKWTAPEAALYG

SEQ ID NO: 12205 - protein, 12 aa, Mus sp.
YEGYALPHAILR

SEQ ID NO: 12206 - protein, 7 aa, Mus sp.
SIASFKD

SEQ ID NO: 12207 - protein, 16 aa, Mus sp.
PLNSVFVAPAVTPVKG

SEQ ID NO: 12208 - protein, 15 aa, Mus sp.
EIQDWSASSPHSAAY

SEQ ID NO: 12209 - protein, 15 aa, Mus sp.
TSPSYSPTSPNYSPT

SEQ ID NO: 12210 - protein, 17 aa, Mus sp.
TAKGLFRAAVPSGASTG

SEQ ID NO: 12211 - protein, 18 aa, Mus sp.
FGNSEFDPPGPNVATTTV

SEQ ID NO: 12212 - protein, 12 aa, Mus sp.
YEWAPPVQNQAL

SEQ ID NO: 12213 - protein, 19 aa, Mus sp.
FPKPPSYNVATTLPSYDEA

SEQ ID NO: 12214 - protein, 20 aa, Mus sp.
WGIDPYDQPNAIYIERHEPF

SEQ ID NO: 12215 - protein, 17 aa, Mus sp.
GENPIYKSAVTTVVNPK

SEQ ID NO: 12216 - protein, 19 aa, Mus sp.
TETKVEPYEVHNPVPLIVG

SEQ ID NO: 12217 - protein, 21 aa, Mus sp.
EDPNYSPQRFPNAHRAFADDP

SEQ ID NO: 12218 - protein, 17 aa, Mus sp.
YPYPTDFLGPLPANPVK

SEQ ID NO: 12219 - protein, 14 aa, Mus sp.
VDEYDYSKPIQGQQ

SEQ ID NO: 12220 - protein, 16 aa, Listeria monocytogenes
EVEDLNQPLAAHVNYE

SEQ ID NO: 12221 - protein, 14 aa, Mus sp.
IASFKDPKISTSLP

SEQ ID NO: 12222 - protein, 15 aa, Mus sp.
QNAWFLPAQADIVAT

SEQ ID NO: 12223 - protein, 16 aa, Mus sp.
TIQWWNMPSPNVDPYD

SEQ ID NO: 12224 - protein, 18 aa, Mus sp.
DHAISDLSMYNYIEMRAH

SEQ ID NO: 12225 - protein, 17 aa, Mus sp.
GDSVVFAGPAGNSVETR

SEQ ID NO: 12226 - protein, 18 aa, Mus sp.
YPYPTDFLGPLPANPVKV

SEQ ID NO: 12227 - protein, 16 aa, Mus sp.
DKDSFSDPYAHVSFLH

SEQ ID NO: 12228 - protein, 20 aa, Mus sp.
YNRDGDSYRSPWSNKYDPPL

SEQ ID NO: 12229 - protein, 15 aa, Mus sp.
TALTFSSPATNQAIT

SEQ ID NO: 12230 - protein, 19 aa, Mus sp.
SPPGGDFSDPVTSATLGIV

SEQ ID NO: 12231 - protein, 24 aa, Mus sp.
LDPAGPNFEYAEAPSRLSPDDADF

SEQ ID NO: 12232 - protein, 15 aa, Mus sp.
SPVFSPANPESSIED

SEQ ID NO: 12233 - protein, 19 aa, Mus sp.
EPPPAYEPPAPAPAPLPPP

SEQ ID NO: 12234 - protein, 11 aa, Mus sp.
QVTQPTVGMNF

SEQ ID NO: 12235 - protein, 16 aa, Mus sp.
EWKDYKAGFGNLEREF

SEQ ID NO: 12236 - protein, 18 aa, Mus sp.
EWTKWVAGSTLPAWIPPS

SEQ ID NO: 12237 - protein, 18 aa, Mus sp.
DLGSDIFAAPAPQSTATA

SEQ ID NO: 12238 - protein, 15 aa, Mus sp.
VKDGYQMAQPVFAPK

SEQ ID NO: 12239 - protein, 14 aa, Mus sp.
VTPWKAPIVWEGTY

SEQ ID NO: 12240 - protein, 14 aa, Mus sp.
AVNWYAPLVAPISK

SEQ ID NO: 12241 - protein, 18 aa, Mus sp.
LAPMYYRGAQAAIVVYDI

SEQ ID NO: 12242 - protein, 17 aa, Mus sp.
AEQEVLAPQVVLSLGGS

SEQ ID NO: 12243 - protein, 20 aa, Mus sp.
QPSTSSLAAPTVEAAASAPA

SEQ ID NO: 12244 - protein, 22 aa, Mus sp.
IQEMEKEDRRYNPPIIHQGFQD

SEQ ID NO: 12245 - protein, 18 aa, Mus sp.
LPKPIIWAEPGSVIAAYT

SEQ ID NO: 12246 - protein, 17 aa, Mus sp.
TGYPTAYPAAAPAYNPS

SEQ ID NO: 12247 - protein, 22 aa, Mus sp.
QPVRKNKMASNIFGTPEENPPS

SEQ ID NO: 12248 - protein, 12 aa, Mus sp.
IFYGASIASLSA

SEQ ID NO: 12249 - protein, 12 aa, Mus sp.
KPFQNPVPNQSP

SEQ ID NO: 12250 - protein, 16 aa, Mus sp.
YPENWRAFKALIAAQY

SEQ ID NO: 12251 - protein, 16 aa, Mus sp.
IEEVYYDHLRCAFKSP

SEQ ID NO: 12252 - protein, 18 aa, Mus sp.
GDSNFGAPSASVAAAPAP

SEQ ID NO: 12253 - protein, 17 aa, Mus sp.
EPLSTVTAPDSPEAAEQ

SEQ ID NO: 12254 - protein, 15 aa, Mus sp.
SGVEWKGPQVSSSLN

SEQ ID NO: 12255 - protein, 16 aa, Mus sp.
YTPYYVAPEVLGPEKY

SEQ ID NO: 12256 - protein, 16 aa, Mus sp.
HTSYYSESVVRESYIG

SEQ ID NO: 12257 - protein, 18 aa, Mus sp.
DLERFLSSAAAVSKEHPV

SEQ ID NO: 12258 - protein, 29 aa, Mus sp.
QPGATTVQEQLRQLFERDWSSHYAMDLDR

SEQ ID NO: 12259 - protein, 17 aa, Mus sp.
AGALAASAPVVAVAGLG

SEQ ID NO: 12260 - protein, 18 aa, Mus sp.
LDKDSFSDPYAHVSFLHR

SEQ ID NO: 12261 - protein, 14 aa, Mus sp.
VTTDHISPAGNIAR

SEQ ID NO: 12262 - protein, 20 aa, Mus sp.
EGKLLEAKGPVTDVAYSHDG

SEQ ID NO: 12263 - protein, 16 aa, Mus sp.
DTNLNDLGPRALEIYR

SEQ ID NO: 12264 - protein, 14 aa, Mus sp.
NVNIFKFIIPNIVK

SEQ ID NO: 12265 - protein, 17 aa, Mus sp.
YIEGYVPSQADVAVFEA

SEQ ID NO: 12266 - protein, 14 aa, Mus sp.
VSFVQPNGAIFEPS

SEQ ID NO: 12267 - protein, 18 aa, Mus sp.
ITRDLKWGTPVPLEGFED

SEQ ID NO: 12268 - protein, 16 aa, Mus sp.
NNQAYHSPATALAIVD

SEQ ID NO: 12269 - protein, 15 aa, Mus sp.
MDEAYVQPEPLGVVL

SEQ ID NO: 12270 - protein, 14 aa, Mus sp.
RDKWLAPDGLIFPD

SEQ ID NO: 12271 - protein, 15 aa, Mus sp.
FVEEFIWPAVQSSAL

SEQ ID NO: 12272 - protein, 19 aa, Mus sp.
DGEEAGAYDGPRTADGIVS

SEQ ID NO: 12273 - protein, 19 aa, Mus sp.
YPRDISNYGFPRSVQAIDA

SEQ ID NO: 12274 - protein, 16 aa, Mus sp.
RRTDWEAPTGQPSAPG

SEQ ID NO: 12275 - protein, 15 aa, Mus sp.
LAETVAPAVRGANPH

SEQ ID NO: 12276 - protein, 16 aa, Mus sp.
QASIYSPPAAAAAAAA

SEQ ID NO: 12277 - protein, 16 aa, Mus sp.
GYKPFQNPVPNQSPSS

SEQ ID NO: 12278 - protein, 16 aa, Mus sp.
GDTHFDSAEPWTVQNE

SEQ ID NO: 12279 - protein, 15 aa, Mus sp.
EKPVPAAPVPSPVAP

SEQ ID NO: 12280 - protein, 14 aa, Mus sp.
ECGENFSRISHLVQ

SEQ ID NO: 12281 - protein, 17 aa, Mus sp.
ESLHLRFSAPQIENEPE

SEQ ID NO: 12282 - protein, 20 aa, Mus sp.
LPDDINVYATTAANPKESSY

SEQ ID NO: 12283 - protein, 22 aa, Mus sp.
DPAGPNFEYAEAPSRLSPDDAD

SEQ ID NO: 12284 - protein, 17 aa, Mus sp.
GQGVFREATTEFSVDAR

SEQ ID NO: 12285 - protein, 16 aa, Mus sp.
APDMVYLGSMTNFDVT

SEQ ID NO: 12286 - protein, 17 aa, Mus sp.
EEKYTVIYPYTARDQDE

SEQ ID NO: 12287 - protein, 18 aa, Mus sp.
DTDRQVWSGSKAAGAPPK

SEQ ID NO: 12288 - protein, 17 aa, Mus sp.
SDGYPVLYPTGWSSSDN

SEQ ID NO: 12289 - protein, 15 aa, Mus sp.
VVFEWKDPFIQKVQD

SEQ ID NO: 12290 - protein, 22 aa, Mus sp.
DGNHTLFHNPHVNPLPTGYEDE

SEQ ID NO: 12291 - protein, 23 aa, Mus sp.
LDPAGPNFEYAEAPSRLSPDDAD

SEQ ID NO: 12292 - protein, 13 aa, Mus sp.
GNSEFDPPGPNVA

SEQ ID NO: 12293 - protein, 15 aa, Mus sp.
AEEVYRNSMPASSFQ

SEQ ID NO: 12294 - protein, 13 aa, Mus sp.
LMLYTRKFESTDP

SEQ ID NO: 12295 - protein, 14 aa, Mus sp.
MDGEWEAPQIANPK

SEQ ID NO: 12296 - protein, 16 aa, Mus sp.
VGETFHASQPSLTVDG

SEQ ID NO: 12297 - protein, 15 aa, Mus sp.
KFRFEEPVVLPDLSD

SEQ ID NO: 12298 - protein, 16 aa, Mus sp.
GTKRYMAPEVLDDSIN

SEQ ID NO: 12299 - protein, 18 aa, Mus sp.
GNMHYDTPDIRRFDPVPA

SEQ ID NO: 12300 - protein, 18 aa, Mus sp.
RPDAEYWNSQPEILERTR

SEQ ID NO: 12301 - protein, 15 aa, Mus sp.
AIFSYEAAQPEDLEF

SEQ ID NO: 12302 - protein, 17 aa, Mus sp.
VSTLIWAAPRLQSEVAE

SEQ ID NO: 12303 - protein, 14 aa, Mus sp.
KFPDWSFPSAWVST

SEQ ID NO: 12304 - protein, 16 aa, Mus sp.
VFPEFAAAHSNLASVL

SEQ ID NO: 12305 - protein, 15 aa, Mus sp.
TMLSGKDTVQHWNWT

SEQ ID NO: 12306 - protein, 17 aa, Mus sp.
GEQSWIQALPSVAKEEK

SEQ ID NO: 12307 - protein, 16 aa, Mus sp.
NLPENFRRPQTDQAVE

SEQ ID NO: 12308 - protein, 16 aa, Mus sp.
APFDWEGAQASQALLL

SEQ ID NO: 12309 - protein, 16 aa, Mus sp.
LQNLYMQWNKISVIGQ

SEQ ID NO: 12310 - protein, 16 aa, Mus sp.
IPPTHYAASRAASVAE

SEQ ID NO: 12311 - protein, 18 aa, Mus sp.
DVVDRVLKSPVASIVYEL

SEQ ID NO: 12312 - protein, 13 aa, Mus sp.
RVPTPNVSVVDLT

SEQ ID NO: 12313 - protein, 15 aa, Mus sp.
DFITMNPSVVQRAFG

SEQ ID NO: 12314 - protein, 23 aa, Mus sp.
KPFPWGDGNHTLFHNPHVNPLPT

SEQ ID NO: 12315 - protein, 17 aa, Mus sp.
GNMHYDTPDIRRFDPVP

SEQ ID NO: 12316 - protein, 15 aa, BOVIN
VVVGPSVVAVPLPLH

SEQ ID NO: 12317 - protein, 15 aa, Mus sp.
HWGEWSPAHPLEAED

SEQ ID NO: 12318 - protein, 22 aa, Mus sp.
DESGFPKPPSYNVATTLPSYDE

SEQ ID NO: 12319 - protein, 16 aa, Mus sp.
AARDNMFSGSKINYTE

SEQ ID NO: 12320 - protein, 18 aa, Mus sp.
EPPPAYEPPAPAPAPLPP

SEQ ID NO: 12321 - protein, 14 aa, Mus sp.
VPWSPPQSNWNPWT

SEQ ID NO: 12322 - protein, 19 aa, Mus sp.
KPADITDVVKPIALPTEEP

SEQ ID NO: 12323 - protein, 17 aa, Mus sp.
DSKLHHGHDPRGGLQPS

SEQ ID NO: 12324 - protein, 18 aa, Mus sp.
LNVLRIINEPTAAAIAYG

SEQ ID NO: 12325 - protein, 16 aa, Mus sp.
VFDVTAPNTFKTLDSW

SEQ ID NO: 12326 - protein, 14 aa, Mus sp.
ISSVTVFYLGQHAM

SEQ ID NO: 12327 - protein, 16 aa, Mus sp.
GYGPYSGAYPAGTQVV

SEQ ID NO: 12328 - protein, 17 aa, Mus sp.
TDRKIVYEGPELNHAFG

SEQ ID NO: 12329 - protein, 12 aa, Mus sp.
DNYRFAHTNIES

SEQ ID NO: 12330 - protein, 17 aa, Mus sp.
FPKPPSYNVATTLPSYD

SEQ ID NO: 12331 - protein, 14 aa, Mus sp.
LEPYLEPRSPEARG

SEQ ID NO: 12332 - protein, 16 aa, Mus sp.
IKVYWDAPSPAPDHIR

SEQ ID NO: 12333 - protein, 15 aa, Mus sp.
LEGDIFIGPKAEEHR

SEQ ID NO: 12334 - protein, 15 aa, Mus sp.
IRGTSYQSPHGIPID

SEQ ID NO: 12335 - protein, 16 aa, Mus sp.
GGDPFAAPQVVPAFAS

SEQ ID NO: 12336 - protein, 17 aa, Mus sp.
RPVQFPYVTPAPHEPVK

SEQ ID NO: 12337 - protein, 25 aa, Mus sp.
GPSAPATPAAEAKAAEAAASAYYNP

SEQ ID NO: 12338 - protein, 16 aa, Mus sp.
IFGIHHNPSVWPDPEV

SEQ ID NO: 12339 - protein, 16 aa, Mus sp.
GIDPYDQPNAIYIERH

SEQ ID NO: 12340 - protein, 17 aa, Mus sp.
NVMRIINEPTAAAIAYG

SEQ ID NO: 12341 - protein, 16 aa, Mus sp.
IARQNFTEPTAIQAQG

SEQ ID NO: 12342 - protein, 17 aa, Mus sp.
SSSIASFKDPKISTSLP

SEQ ID NO: 12343 - protein, 16 aa, Mus sp.
KPPSYNVATTLPSYDE

SEQ ID NO: 12344 - protein, 16 aa, Mus sp.
LPKPIIWAEPGSVIAA

SEQ ID NO: 12345 - protein, 17 aa, Mus sp.
NQLEALVGPEANVGPYG

SEQ ID NO: 12346 - protein, 19 aa, Mus sp.
HPDKGGSPYIAAKINEAKD

SEQ ID NO: 12347 - protein, 15 aa, Mus sp.
KELEEQLGPVAEETR

SEQ ID NO: 12348 - protein, 15 aa, Mus sp.
GLPDYSAPNPIKVTH

SEQ ID NO: 12349 - protein, 15 aa, Mus sp.
SMRYFETAVSRPGLE

SEQ ID NO: 12350 - protein, 19 aa, Mus sp.
ALEDPDGFSWPATLPSVYK

SEQ ID NO: 12351 - protein, 16 aa, Mus sp.
EVLDYSTPTTNGTPEA

SEQ ID NO: 12352 - protein, 15 aa, Mus sp.
EQRATFHTPEAPPNL

SEQ ID NO: 12353 - protein, 14 aa, Mus sp.
FPYVTPAPHEPVKT

SEQ ID NO: 12354 - protein, 18 aa, Mus sp.
LITGVDFIGSTVGLAKVS

SEQ ID NO: 12355 - protein, 13 aa, Mus sp.
SDEGERYIAPTVL

SEQ ID NO: 12356 - protein, 15 aa, Mus sp.
YTPYYVAPEVLGPEK

SEQ ID NO: 12357 - protein, 14 aa, Mus sp.
TNDRYVASLAARNK

SEQ ID NO: 12358 - protein, 16 aa, Mus sp.
VLDNYLTSPLPEEVDE

SEQ ID NO: 12359 - protein, 13 aa, Mus sp.
SIASFKDPKISTS

SEQ ID NO: 12360 - protein, 18 aa, Mus sp.
FPGAQHYVGGNAALIGQR

SEQ ID NO: 12361 - protein, 17 aa, Mus sp.
GTVIHFNNPKVQASLAA

SEQ ID NO: 12362 - protein, 16 aa, Mus sp.
GDSNFGAPSASVAAAP

SEQ ID NO: 12363 - protein, 15 aa, Mus sp.
LDDFEAGTATAAPPG

SEQ ID NO: 12364 - protein, 19 aa, Mus sp.
TPSAAYLWVGAGASEAEKT

SEQ ID NO: 12365 - protein, 14 aa, Mus sp.
KVELVPPTPAEIPT

SEQ ID NO: 12366 - protein, 8 aa, Mus sp.
SVLQFLGL

SEQ ID NO: 12367 - protein, 12 aa, Mus sp.
EFDYSGSQAIKA

SEQ ID NO: 12368 - protein, 14 aa, Mus sp.
TLPDFHVPEITIPE

SEQ ID NO: 12369 - protein, 13 aa, Mus sp.
EKEDRRYNPPIIH

SEQ ID NO: 12370 - protein, 16 aa, Mus sp.
QIPKVVKSPSSLPAKP

SEQ ID NO: 12371 - protein, 16 aa, Mus sp.
EQEVLAPQVVLSLGGS

SEQ ID NO: 12372 - protein, 16 aa, Mus sp.
DKQREEYQPATPGLGM

SEQ ID NO: 12373 - protein, 18 aa, Mus sp.
DERFGVRFPAMSDAYDRD

SEQ ID NO: 12374 - protein, 18 aa, Mus sp.
APAAAATTAAPAAAAAPA

SEQ ID NO: 12375 - protein, 16 aa, Mus sp.
APINAFIGGLAAQEVM

SEQ ID NO: 12376 - protein, 21 aa, Mus sp.
SEIDLKGIPVYRFVLPANAFA

SEQ ID NO: 12377 - protein, 18 aa, Mus sp.
RDGDSYRSPWSNKYDPPL

SEQ ID NO: 12378 - protein, 17 aa, Mus sp.
VDAGNAFKKADPQEAIN

SEQ ID NO: 12379 - protein, 19 aa, Mus sp.
SPRDDARVYHDPSTQEPVT

SEQ ID NO: 12380 - protein, 15 aa, Mus sp.
LRDNYRFAHTNIESL

SEQ ID NO: 12381 - protein, 17 aa, Mus sp.
KPWNQYRLPKTLIPDSY

SEQ ID NO: 12382 - protein, 16 aa, Mus sp.
DPYDQPNAIYIERHEP

SEQ ID NO: 12383 - protein, 17 aa, Mus sp.
ATPRDYYFALAHTVRDH

SEQ ID NO: 12384 - protein, 15 aa, Mus sp.
EGSYEAAKILLDHFA

SEQ ID NO: 12385 - protein, 15 aa, Mus sp.
APGGYVAPKAVWLPA

SEQ ID NO: 12386 - protein, 16 aa, Mus sp.
DTVTISGPQAAVNEFV

SEQ ID NO: 12387 - protein, 15 aa, Mus sp.
GALLLNAPVVSITQG

SEQ ID NO: 12388 - protein, 13 aa, Mus sp.
YLPYKSPGINVDS

SEQ ID NO: 12389 - protein, 9 aa, Mus sp.
GRDFYKILG

SEQ ID NO: 12390 - protein, 18 aa, Mus sp.
EEKPVPAAPVPSPVAPAP

SEQ ID NO: 12391 - protein, 16 aa, Mus sp.
APLPPWKTPSSSQPPP

SEQ ID NO: 12392 - protein, 18 aa, Mus sp.
KVGGERFEAPEALFQPHL

SEQ ID NO: 12393 - protein, 14 aa, Mus sp.
DLDETRQAIVNAAK

SEQ ID NO: 12394 - protein, 14 aa, Mus sp.
DTVTISGPQAAVNE

SEQ ID NO: 12395 - protein, 16 aa, Mus sp.
KRSNEFDYPSVGQLAH

SEQ ID NO: 12396 - protein, 26 aa, Mus sp.
ITGLDPAGPNFEYAEAPSRLSPDDAD

SEQ ID NO: 12397 - protein, 16 aa, Mus sp.
VTYEWAPPVQNQALAR

SEQ ID NO: 12398 - protein, 22 aa, Mus sp.
APETRSQVTPSVPSEALDDSTG

SEQ ID NO: 12399 - protein, 21 aa, Mus sp.
GPDGKGMNPPSYYTQPVPVPN

SEQ ID NO: 12400 - protein, 16 aa, Mus sp.
VLIPYQGPSSDYVVVK

SEQ ID NO: 12401 - protein, 18 aa, Mus sp.
DEAQVEFMASHGNEAARA

SEQ ID NO: 12402 - protein, 15 aa, Mus sp.
VDPFKAVDTNRASMG

SEQ ID NO: 12403 - protein, 17 aa, Mus sp.
LHQALKMLWQNLHQFGQ

SEQ ID NO: 12404 - protein, 14 aa, Mus sp.
TIPFYTPIPNGLYP

SEQ ID NO: 12405 - protein, 16 aa, Mus sp.
SHPQYAEPGAEAAFSG

SEQ ID NO: 12406 - protein, 15 aa, Mus sp.
SVPATFAPSPTPAVV

SEQ ID NO: 12407 - protein, 16 aa, Mus sp.
KPVPAAPVPSPVAPAP

SEQ ID NO: 12408 - protein, 19 aa, Mus sp.
ITDKFWGPSGAESVIGGVH

SEQ ID NO: 12409 - protein, 13 aa, Mus sp.
GGYVAPKAVWLPA

SEQ ID NO: 12410 - protein, 17 aa, Mus sp.
NPDYKGTWIHPEIDNPE

SEQ ID NO: 12411 - protein, 16 aa, Mus sp.
LEDFYGSPIPSVSLKL

SEQ ID NO: 12412 - protein, 18 aa, Mus sp.
DGDSVVFAGPAGNSVETR

SEQ ID NO: 12413 - protein, 18 aa, Mus sp.
DPDSRGEYSWAVAQGVKQ

SEQ ID NO: 12414 - protein, 19 aa, Mus sp.
LPDDINVYATTAANPKESS

SEQ ID NO: 12415 - protein, 14 aa, Mus sp.
APVPSPVAPAPVPS

SEQ ID NO: 12416 - protein, 17 aa, Mus sp.
IAGVVYKDGIVLGADTR

SEQ ID NO: 12417 - protein, 23 aa, Mus sp.
DVDFEGVKKKAGYITPVPGGVGP

SEQ ID NO: 12418 - protein, 17 aa, Mus sp.
LTGMAFRVPTPNVSVVD

SEQ ID NO: 12419 - protein, 20 aa, Mus sp.
TPSAAYLWVGAGASEAEKTG

SEQ ID NO: 12420 - protein, 20 aa, Mus sp.
IGDTIEFRGPNGLLVYQGKG

SEQ ID NO: 12421 - protein, 15 aa, Mus sp.
NPLNSVFVAPAVTPV

SEQ ID NO: 12422 - protein, 21 aa, Mus sp.
YPPPPQSDSASSPSPSFSEDN

SEQ ID NO: 12423 - protein, 17 aa, Mus sp.
FAAEEFKVPAATSAIIT

SEQ ID NO: 12424 - protein, 16 aa, Mus sp.
APMYYRGSAAAVIVYD

SEQ ID NO: 12425 - protein, 24 aa, Mus sp.
EEKYHEALAKGDVTTQVALQPALK

SEQ ID NO: 12426 - protein, 9 aa, Mus sp.
ELFPVFTQL

SEQ ID NO: 12427 - protein, 18 aa, Mus sp.
DTIEFRGPNGLLVYQGKG

SEQ ID NO: 12428 - protein, 16 aa, Mus sp.
GMAFRVPTPNVSVVDL

SEQ ID NO: 12429 - protein, 12 aa, Mus sp.
VVPWSPPQSNWN

SEQ ID NO: 12430 - protein, 16 aa, Mus sp.
IPKVVKSPSSLPAKPL

SEQ ID NO: 12431 - protein, 15 aa, Mus sp.
EDAIQFATGMANALE

SEQ ID NO: 12432 - protein, 15 aa, Mus sp.
YIPTYTKPNPNQIIS

SEQ ID NO: 12433 - protein, 12 aa, Mus sp.
DLQYAAPGGLIG

SEQ ID NO: 12434 - protein, 17 aa, Mus sp.
KELSFAPPMSDRSGDGI

SEQ ID NO: 12435 - protein, 16 aa, Mus sp.
DDLQPWHPFGVDSVPA

SEQ ID NO: 12436 - protein, 16 aa, Mus sp.
DITHTYKYPEGSPEER

SEQ ID NO: 12437 - protein, 16 aa, Mus sp.
SVTYYGPSGQKTIYSE

SEQ ID NO: 12438 - protein, 13 aa, Mus sp.
GEFDYSGSQAIKA

SEQ ID NO: 12439 - protein, 14 aa, Mus sp.
HDLDFRAPHVLVLG

SEQ ID NO: 12440 - protein, 14 aa, Mus sp.
GIPVYRFVLPANAF

SEQ ID NO: 12441 - protein, 16 aa, Mus sp.
DHRGTWNGPWVSTEVL

SEQ ID NO: 12442 - protein, 16 aa, Mus sp.
VVLYHRSPTANENQNL

SEQ ID NO: 12443 - protein, 18 aa, Mus sp.
VNKGFYKEATQLWGKAEM

SEQ ID NO: 12444 - protein, 14 aa, Mus sp.
DIDSFVPSKAAPAA

SEQ ID NO: 12445 - protein, 14 aa, Mus sp.
APFDWEGAQASQAL

SEQ ID NO: 12446 - protein, 15 aa, Mus sp.
GSFVYKGGKIYKVPS

SEQ ID NO: 12447 - protein, 17 aa, Mus sp.
FAISYVAALPAAALWHK

SEQ ID NO: 12448 - protein, 14 aa, Mus sp.
TPDIIINPHAIPSR

SEQ ID NO: 12449 - protein, 14 aa, Mus sp.
QKQQWITPFTNGDK

SEQ ID NO: 12450 - protein, 15 aa, Mus sp.
LHLRFSAPQIENEPE

SEQ ID NO: 12451 - protein, 16 aa, Mus sp.
LRDMYSKSSAAMSTYA

SEQ ID NO: 12452 - protein, 17 aa, Mus sp.
LPEAPSAESPSPSESPP

SEQ ID NO: 12453 - protein, 15 aa, Mus sp.
RDKWLAPDGLIFPDR

SEQ ID NO: 12454 - protein, 16 aa, Mus sp.
KWKALYTDPKSSETAA

SEQ ID NO: 12455 - protein, 15 aa, Mus sp.
STQLIRNGDWTFQVL

SEQ ID NO: 12456 - protein, 15 aa, Mus sp.
AEEYEFLTPMEEAPK

SEQ ID NO: 12457 - protein, 13 aa, Mus sp.
LSIQWESSRPLLA

SEQ ID NO: 12458 - protein, 11 aa, Mus sp.
SYPVYLMEQQN

SEQ ID NO: 12459 - protein, 17 aa, Mus sp.
GTPEYLAPEVLEDNDYG

SEQ ID NO: 12460 - protein, 17 aa, Mus sp.
KNVTELNEPLSNEERNL

SEQ ID NO: 12461 - protein, 17 aa, Mus sp.
SPSSPEYTPASPKYSPT

SEQ ID NO: 12462 - protein, 16 aa, Mus sp.
GNMHYDTPDIRRFDPV

SEQ ID NO: 12463 - protein, 15 aa, Mus sp.
PLNSVFVAPAVTPVK

SEQ ID NO: 12464 - protein, 22 aa, Mus sp.
EMEKEDRRYNPPIIHQGFQDTS

SEQ ID NO: 12465 - protein, 20 aa, Mus sp.
NWPHLEEARVVAVSDGETKF

SEQ ID NO: 12466 - protein, 18 aa, Mus sp.
FAAEEFKVPAATSAIITN

SEQ ID NO: 12467 - protein, 16 aa, Mus sp.
HKAFLEVNEEGSEAAA

SEQ ID NO: 12468 - protein, 16 aa, Mus sp.
FGPYYTEPVIAGLDPK

SEQ ID NO: 12469 - protein, 14 aa, Mus sp.
SNPSYNYEIVNRAS

SEQ ID NO: 12470 - protein, 13 aa, Mus sp.
VRVDEYDYSKPIQ

SEQ ID NO: 12471 - protein, 11 aa, Mus sp.
VLAPQVVLSLG

SEQ ID NO: 12472 - protein, 20 aa, Mus sp.
LLPLGEPTAVYKVRTPSAAT

SEQ ID NO: 12473 - protein, 17 aa, Mus sp.
LLEAKGPVTDVAYSHDG

SEQ ID NO: 12474 - protein, 19 aa, Mus sp.
TPPSPKVTYKAPVPTGEVY

SEQ ID NO: 12475 - protein, 17 aa, Mus sp.
EWKDYKAGFGNLEREFW

SEQ ID NO: 12476 - protein, 11 aa, Mus sp.
RYMAPEVLDDS

SEQ ID NO: 12477 - protein, 19 aa, Mus sp.
GPEVDVSLPKANIDVSGPK

SEQ ID NO: 12478 - protein, 15 aa, Mus sp.
LAVLEQEPIVLPAWD

SEQ ID NO: 12479 - protein, 19 aa, Mus sp.
KPVPAAPVPSPVAPAPVPS

SEQ ID NO: 12480 - protein, 18 aa, Mus sp.
DPGVPSEWTSPASAGSSD

SEQ ID NO: 12481 - protein, 16 aa, Mus sp.
LRDNYRFAHTNIESLV

SEQ ID NO: 12482 - protein, 18 aa, Mus sp.
TPRVLSQAPSPLYSVEFS

SEQ ID NO: 12483 - protein, 17 aa, Mus sp.
EYQQYQDATAEEEEDFG

SEQ ID NO: 12484 - protein, 16 aa, Mus sp.
GQDHVDFSQPEPHTVL

SEQ ID NO: 12485 - protein, 15 aa, Mus sp.
TVIHFNNPKVQASLA

SEQ ID NO: 12486 - protein, 20 aa, Mus sp.
APWDPQLSYAVSWAKVSESG

SEQ ID NO: 12487 - protein, 15 aa, Mus sp.
ITYSYAGARAPMGQG

SEQ ID NO: 12488 - protein, 18 aa, Mus sp.
SGAVIFNFPGTRNEVIPM

SEQ ID NO: 12489 - protein, 14 aa, Mus sp.
RLEQPNVVISLSRT

SEQ ID NO: 12490 - protein, 16 aa, Mus sp.
KLLEAKGPVTDVAYSH

SEQ ID NO: 12491 - protein, 20 aa, BOVIN
GPPVASVVVGPSVVAVPLPL

SEQ ID NO: 12492 - protein, 14 aa, Mus sp.
GDIFIGPKAEEHRG

SEQ ID NO: 12493 - protein, 15 aa, Mus sp.
RAGYKAAIVHNVDSD

SEQ ID NO: 12494 - protein, 11 aa, Mus sp.
LEVVKKDYDAL

SEQ ID NO: 12495 - protein, 11 aa, Mus sp.
SVFVAPRKGIY

SEQ ID NO: 12496 - protein, 20 aa, Mus sp.
APISSHTAPRPNPTPALPQP

SEQ ID NO: 12497 - protein, 14 aa, Mus sp.
TPWKAPIVWEGTYD

SEQ ID NO: 12498 - protein, 11 aa, Mus sp.
LPYKSPGINVD

SEQ ID NO: 12499 - protein, 18 aa, BOVIN
PPVASVVVGPSVVAVPLP

SEQ ID NO: 12500 - protein, 15 aa, Mus sp.
NINQWTASIVEQSIT

SEQ ID NO: 12501 - protein, 23 aa, Mus sp.
LPNKPTVTVVSPLPNDSINPQPS

SEQ ID NO: 12502 - protein, 19 aa, Mus sp.
IQASVATNPIITPVAQENQ

SEQ ID NO: 12503 - protein, 14 aa, Mus sp.
DPYDQPNAIYIERH

SEQ ID NO: 12504 - protein, 20 aa, Mus sp.
KGEQIYYAGPVNNPGLDVPQ

SEQ ID NO: 12505 - protein, 19 aa, Mus sp.
TPSPESPDQWSSSSPHSAS

SEQ ID NO: 12506 - protein, 17 aa, Mus sp.
GGYGTLQHGEDTVPQGP

SEQ ID NO: 12507 - protein, 15 aa, Mus sp.
KFLPNAPKALIVEPS

SEQ ID NO: 12508 - protein, 17 aa, Mus sp.
KELEEQLGPVAEETRAR

SEQ ID NO: 12509 - protein, 17 aa, Mus sp.
VPSVIYTHPEVAWVGKS

SEQ ID NO: 12510 - protein, 14 aa, Mus sp.
LDYFKGAIPIRKLV

SEQ ID NO: 12511 - protein, 15 aa, Mus sp.
INDIIRAPTIEQMKD

SEQ ID NO: 12512 - protein, 19 aa, Mus sp.
DTGENPIYKSAVTTVVNPK

SEQ ID NO: 12513 - protein, 16 aa, Mus sp.
KVSDYISPLLSFAAEH

SEQ ID NO: 12514 - protein, 13 aa, Mus sp.
IPYQGPSSDYVVV

SEQ ID NO: 12515 - protein, 17 aa, Mus sp.
SQELVRAPTAALSPEPQ

SEQ ID NO: 12516 - protein, 20 aa, Mus sp.
TPSPESPDQWSSSSPHSNIS

SEQ ID NO: 12517 - protein, 17 aa, Mus sp.
ADKTVKGPDGLTALEAT

SEQ ID NO: 12518 - protein, 14 aa, Mus sp.
RTVITPDPNLSIDQ

SEQ ID NO: 12519 - protein, 16 aa, Mus sp.
EPRVLPYHPAQPGQAT

SEQ ID NO: 12520 - protein, 18 aa, Mus sp.
ESKATYSTNSPVWEEAFR

SEQ ID NO: 12521 - protein, 23 aa, Mus sp.
VPDGPEAPLDELVGAYPNYNEEE

SEQ ID NO: 12522 - protein, 17 aa, Mus sp.
GAVIFNFPGTRNEVIPM

SEQ ID NO: 12523 - protein, 20 aa, Mus sp.
VDLYTAKGLFRAAVPSGAST

SEQ ID NO: 12524 - protein, 21 aa, Mus sp.
SPLPVPVYAPKIPNQFRPDPP

SEQ ID NO: 12525 - protein, 13 aa, Mus sp.
ALVYTSPVIPELK

SEQ ID NO: 12526 - protein, 15 aa, Mus sp.
GTPDYIAPEILQGLK

SEQ ID NO: 12527 - protein, 14 aa, Mus sp.
FDFAGPAIHGSAVF

SEQ ID NO: 12528 - protein, 16 aa, Mus sp.
VKDGYQMAQPVFAPKN

SEQ ID NO: 12529 - protein, 18 aa, Mus sp.
LDIYVWRGAQATLSNTTK

SEQ ID NO: 12530 - protein, 15 aa, Mus sp.
EVSSVEAPSVSPARH

SEQ ID NO: 12531 - protein, 16 aa, Mus sp.
YLPETFRRPQIDPAVE

SEQ ID NO: 12532 - protein, 14 aa, Mus sp.
ASPELTSPLANQSL

SEQ ID NO: 12533 - protein, 16 aa, Mus sp.
IQPFHRAAAIQAISLD

SEQ ID NO: 12534 - protein, 16 aa, Mus sp.
TGVDFIGSTVGLAKVS

SEQ ID NO: 12535 - protein, 15 aa, Mus sp.
APTSALGPKASPAPS

SEQ ID NO: 12536 - protein, 15 aa, Mus sp.
LALPYDTPVPGYMNN

SEQ ID NO: 12537 - protein, 18 aa, Mus sp.
VLEMYKVHNPVPLIVGSS

SEQ ID NO: 12538 - protein, 16 aa, Mus sp.
LALPYDTPVPGYMNNT

SEQ ID NO: 12539 - protein, 13 aa, Mus sp.
EVYTFPVPERHLE

SEQ ID NO: 12540 - protein, 14 aa, Mus sp.
EVEHWFYPQENIID

SEQ ID NO: 12541 - protein, 19 aa, Mus sp.
AGEVKAFFESHPAPSAERT

SEQ ID NO: 12542 - protein, 17 aa, Mus sp.
YLPETFRRPQIDPAVEG

SEQ ID NO: 12543 - protein, 21 aa, Mus sp.
EKWEETELDQLFSGPLPGRLP

SEQ ID NO: 12544 - protein, 17 aa, Mus sp.
DRNRPYVFSAPSESVEL

SEQ ID NO: 12545 - protein, 16 aa, Mus sp.
NHIEVWERPLSNLAWA

SEQ ID NO: 12546 - protein, 15 aa, Mus sp.
LEEQLGPVAEETRAR

SEQ ID NO: 12547 - protein, 15 aa, Mus sp.
EQLEWLSQRANALLA

SEQ ID NO: 12548 - protein, 11 aa, Mus sp.
RVPTPNVSVVD

SEQ ID NO: 12549 - protein, 17 aa, Mus sp.
DVDFDFAGPAIHGSAVF

SEQ ID NO: 12550 - protein, 15 aa, Mus sp.
AVNWYAPLVAPISKD

SEQ ID NO: 12551 - protein, 14 aa, Mus sp.
IDQYQGADAVGLEE

SEQ ID NO: 12552 - protein, 15 aa, Mus sp.
EFDYSGSQAIKALKE

SEQ ID NO: 12553 - protein, 14 aa, Mus sp.
RGTSYQSPHGIPID

SEQ ID NO: 12554 - protein, 15 aa, Mus sp.
RPDAEYWNSQPEILE

SEQ ID NO: 12555 - protein, 14 aa, Mus sp.
IPYQGPSSDYVVVK

SEQ ID NO: 12556 - protein, 21 aa, Mus sp.
DDREDITHTYKYPEGSPEERE

SEQ ID NO: 12557 - protein, 13 aa, Mus sp.
APDTRFVAPGALG

SEQ ID NO: 12558 - protein, 17 aa, Mus sp.
DSKQYYQQPTATAAAVA

SEQ ID NO: 12559 - protein, 15 aa, Mus sp.
EWKFTITPPSAQVVG

SEQ ID NO: 12560 - protein, 16 aa, Mus sp.
KERYSYVCPDLVKEFN

SEQ ID NO: 12561 - protein, 13 aa, Mus sp.
VQIYHNPTANSFR

SEQ ID NO: 12562 - protein, 20 aa, Mus sp.
NKPTVTVVSPLPNDSINPQP

SEQ ID NO: 12563 - protein, 17 aa, Mus sp.
FWPPVTNTEMFVTAPDN

SEQ ID NO: 12564 - protein, 17 aa, Mus sp.
VIKSGYKIPELSQSLDY

SEQ ID NO: 12565 - protein, 15 aa, Mus sp.
MPDMHFKAPKISMPD

SEQ ID NO: 12566 - protein, 18 aa, Mus sp.
DSPDVVYSPETIEARYEY

SEQ ID NO: 12567 - protein, 16 aa, Mus sp.
AINDYKGAVIVVSHDA

SEQ ID NO: 12568 - protein, 17 aa, Mus sp.
NNQAYHSPATALAIVDN

SEQ ID NO: 12569 - protein, 15 aa, Mus sp.
FYSKYSAPRLPAALE

SEQ ID NO: 12570 - protein, 12 aa, Mus sp.
ALKPEYVAPLVL

SEQ ID NO: 12571 - protein, 16 aa, Mus sp.
LNLDWQYPGSRGSPPK

SEQ ID NO: 12572 - protein, 15 aa, Mus sp.
VVIEVFTPVVQRILK

SEQ ID NO: 12573 - protein, 21 aa, Listeria monocytogenes
SSYPGSDETPPVVNPGETNPP

SEQ ID NO: 12574 - protein, 16 aa, Mus sp.
SMPDYKPSFPKWARQD

SEQ ID NO: 12575 - protein, 22 aa, Mus sp.
MEKIQASVATNPIITPVAQENQ

SEQ ID NO: 12576 - protein, 21 aa, Mus sp.
VDLYTAKGLFRAAVPSGASTG

SEQ ID NO: 12577 - protein, 14 aa, Mus sp.
YTRYHCSLPVPEPS

SEQ ID NO: 12578 - protein, 15 aa, Mus sp.
VTPWKAPIVWEGTYD

SEQ ID NO: 12579 - protein, 11 aa, Mus sp.
YTIPFYTPIPN

SEQ ID NO: 12580 - protein, 16 aa, Mus sp.
EFSFWNEPVPRPGPNI

SEQ ID NO: 12581 - protein, 20 aa, Mus sp.
YPRDISNYGFPRSVQAIDAA

SEQ ID NO: 12582 - protein, 14 aa, Mus sp.
SRVQIYHNPTANSF

SEQ ID NO: 12583 - protein, 15 aa, Mus sp.
TVTPWKAPIVWEGTY

SEQ ID NO: 12584 - protein, 13 aa, Mus sp.
TPEYLAPEIILSK

SEQ ID NO: 12585 - protein, 20 aa, Mus sp.
IDNSKEFEFIESQTSSHRIN

SEQ ID NO: 12586 - protein, 14 aa, Mus sp.
TAPEYYAPEVHQHD

SEQ ID NO: 12587 - protein, 14 aa, Mus sp.
YDPIISPEVAASFG

SEQ ID NO: 12588 - protein, 16 aa, Mus sp.
FQHPYNTLKYPNGEGG

SEQ ID NO: 12589 - protein, 12 aa, Mus sp.
ISWEPPAVSVRY

SEQ ID NO: 12590 - protein, 17 aa, Mus sp.
APLDELVGAYPNYNEEE

SEQ ID NO: 12591 - protein, 18 aa, Mus sp.
FKKWVNTPFTASSIELVP

SEQ ID NO: 12592 - protein, 17 aa, Mus sp.
VPYPRIHFPLATYAPVI

SEQ ID NO: 12593 - protein, 16 aa, Mus sp.
VAVNWYAPLVAPISKD

SEQ ID NO: 12594 - protein, 14 aa, Mus sp.
YLNEYGAPDAGGLE

SEQ ID NO: 12595 - protein, 17 aa, Mus sp.
DSVTTDHISPAGNIARN

SEQ ID NO: 12596 - protein, 15 aa, Mus sp.
APAPAEAPAAAEAPA

SEQ ID NO: 12597 - protein, 14 aa, Mus sp.
GNSEFDPPGPNVAT

SEQ ID NO: 12598 - protein, 12 aa, Mus sp.
IEVAPPKAHEVR

SEQ ID NO: 12599 - protein, 18 aa, Mus sp.
GDLERFLSSAAAVSKEHP

SEQ ID NO: 12600 - protein, 14 aa, Mus sp.
LDYWTYPGSLTTPP

SEQ ID NO: 12601 - protein, 16 aa, Mus sp.
IDWTYRPPSSSRTESI

SEQ ID NO: 12602 - protein, 12 aa, Mus sp.
SVFVAPAVTPVK

SEQ ID NO: 12603 - protein, 16 aa, Mus sp.
SPVTTASMSGCLSFYY

SEQ ID NO: 12604 - protein, 14 aa, Mus sp.
WKALYTDPKSSETA

SEQ ID NO: 12605 - protein, 15 aa, Mus sp.
GPPIFNPVANEVYLN

SEQ ID NO: 12606 - protein, 16 aa, Mus sp.
LPSTWSDPSVNISLDN

SEQ ID NO: 12607 - protein, 16 aa, Mus sp.
MRPFYQGPVGDPATYR

SEQ ID NO: 12608 - protein, 16 aa, Mus sp.
VADLVKNPTASLVLPE

SEQ ID NO: 12609 - protein, 26 aa, Mus sp.
FPGPNIGGDTHFDSAEPWTVQNEDLN

SEQ ID NO: 12610 - protein, 19 aa, Mus sp.
KGADKTVKGPDGLTALEAT

SEQ ID NO: 12611 - protein, 24 aa, Mus sp.
GQDGEQAPPLPIKTPIPTPSTLPA

SEQ ID NO: 12612 - protein, 19 aa, Mus sp.
SSSIASFKDPKISTSLPVL

SEQ ID NO: 12613 - protein, 14 aa, Mus sp.
KKFRFEEPVVLPDL

SEQ ID NO: 12614 - protein, 14 aa, Mus sp.
TPDYIAPEILQGLK

SEQ ID NO: 12615 - protein, 14 aa, Mus sp.
SPTYTPSSPSYSPS

SEQ ID NO: 12616 - protein, 19 aa, Mus sp.
SAPVEGASPTSISAVDGLT

SEQ ID NO: 12617 - protein, 17 aa, Mus sp.
EQLPNVQVEGPTPNRPR

SEQ ID NO: 12618 - protein, 12 aa, Mus sp.
GLPDYSAPNPIK

SEQ ID NO: 12619 - protein, 14 aa, Mus sp.
NVTELNEPLSNEER

SEQ ID NO: 12620 - protein, 13 aa, Mus sp.
DFYGSPIPSVSLK

SEQ ID NO: 12621 - protein, 14 aa, Mus sp.
AWVAFPLALVSGTV

SEQ ID NO: 12622 - protein, 18 aa, Mus sp.
SVPPSVSPSPATAFSGPP

SEQ ID NO: 12623 - protein, 15 aa, Mus sp.
RPEEVEAEAVNRSIT

SEQ ID NO: 12624 - protein, 16 aa, Mus sp.
RNYEYYASHVPESVKN

SEQ ID NO: 12625 - protein, 16 aa, Mus sp.
GDISISGPKVNVEAPN

SEQ ID NO: 12626 - protein, 21 aa, Mus sp.
GVEAARDNMFSGSKINYTENR

SEQ ID NO: 12627 - protein, 14 aa, Mus sp.
NPPSYYTQPVPVPN

SEQ ID NO: 12628 - protein, 16 aa, Mus sp.
SLHLRFSAPQIENEPE

SEQ ID NO: 12629 - protein, 16 aa, Mus sp.
LDKEIYYHGEPISVNV

SEQ ID NO: 12630 - protein, 14 aa, Mus sp.
KFRFEEPVVLPDLS

SEQ ID NO: 12631 - protein, 12 aa, Mus sp.
INYQPPTVVPGG

SEQ ID NO: 12632 - protein, 15 aa, Mus sp.
NVQFSSPLPGEAVKD

SEQ ID NO: 12633 - protein, 13 aa, Mus sp.
RSYSSPDITQALQ

SEQ ID NO: 12634 - protein, 16 aa, Mus sp.
ITDKFWGPSGAESVIG

SEQ ID NO: 12635 - protein, 16 aa, Mus sp.
GKWKYEKPDGSPVFIA

SEQ ID NO: 12636 - protein, 18 aa, Mus sp.
LLKGQMGLYIFQNTHAID

SEQ ID NO: 12637 - protein, 15 aa, Mus sp.
NRYWGTPIPLWVSED

SEQ ID NO: 12638 - protein, 17 aa, Mus sp.
HWGEWSPAHPLEAEDTR

SEQ ID NO: 12639 - protein, 16 aa, Mus sp.
DDARVYHDPSTQEPVT

SEQ ID NO: 12640 - protein, 15 aa, Mus sp.
LTTSSYSNPTIGYEN

SEQ ID NO: 12641 - protein, 16 aa, Mus sp.
VGAGHFRSPHTTEVVG

SEQ ID NO: 12642 - protein, 15 aa, Mus sp.
APISSHTAPRPNPTP

SEQ ID NO: 12643 - protein, 16 aa, Mus sp.
KEVDRYDAPGIAFYPG

SEQ ID NO: 12644 - protein, 17 aa, Mus sp.
LLPEYANAEIVRTRDPE

SEQ ID NO: 12645 - protein, 14 aa, Mus sp.
VPWNFHEPQPGQYE

SEQ ID NO: 12646 - protein, 17 aa, Mus sp.
GVPVPGSPFPLEAVAPT

SEQ ID NO: 12647 - protein, 20 aa, Mus sp.
SPTSPSYSPTSPSYSPTSPS

SEQ ID NO: 12648 - protein, 23 aa, Mus sp.
GIKADKADKAAASGPASASAPAA

SEQ ID NO: 12649 - protein, 19 aa, Mus sp.
TPAAPTSALGPKASPAPSH

SEQ ID NO: 12650 - protein, 21 aa, Mus sp.
RPDAFAISYVAALPAAALWHK

SEQ ID NO: 12651 - protein, 14 aa, Mus sp.
DYVPPTANLDQKDK

SEQ ID NO: 12652 - protein, 14 aa, Mus sp.
SPYINPIIPFTGPI

SEQ ID NO: 12653 - protein, 17 aa, Mus sp.
SPDVVYSPETIEARYEY

SEQ ID NO: 12654 - protein, 18 aa, Mus sp.
TEQTYWQATPFRAVAEPG

SEQ ID NO: 12655 - protein, 15 aa, Mus sp.
EEEVEVFLPKFKLEE

SEQ ID NO: 12656 - protein, 16 aa, Mus sp.
APTPAATPAASPAPVS

SEQ ID NO: 12657 - protein, 17 aa, Mus sp.
SEERVYMVGKANSVFED

SEQ ID NO: 12658 - protein, 19 aa, Mus sp.
SPPPYAAYATPTPEVYGYG

SEQ ID NO: 12659 - protein, 16 aa, Mus sp.
KKFRFEEPVVLPDLSD

SEQ ID NO: 12660 - protein, 14 aa, Mus sp.
EDKVYWTDVINEAI

SEQ ID NO: 12661 - protein, 15 aa, Mus sp.
VPSVIYTHPEVAWVG

SEQ ID NO: 12662 - protein, 19 aa, Mus sp.
DIDTAAKFIGAGAATVGVA

SEQ ID NO: 12663 - protein, 19 aa, Mus sp.
ATITVYSFPESVELRPLPA

SEQ ID NO: 12664 - protein, 14 aa, Mus sp.
IDWTYRPPSSSRTE

SEQ ID NO: 12665 - protein, 11 aa, Mus sp.
LKPEYVAPLVL

SEQ ID NO: 12666 - protein, 15 aa, Mus sp.
KGSVFSAPSASGTPN

SEQ ID NO: 12667 - protein, 20 aa, Mus sp.
DLDEQEFVYKEPAITKLPEI

SEQ ID NO: 12668 - protein, 16 aa, Mus sp.
EQFVYSSPHDNKSWEM

SEQ ID NO: 12669 - protein, 18 aa, Mus sp.
VSPTVHFTPAEISRSVFE

SEQ ID NO: 12670 - protein, 16 aa, Mus sp.
DIRSDWTNPEINKAVL

SEQ ID NO: 12671 - protein, 17 aa, Mus sp.
LLGNMWAQTWSNIYDLV

SEQ ID NO: 12672 - protein, 20 aa, Mus sp.
ESTEQLPNVQVEGPTPNRPR

SEQ ID NO: 12673 - protein, 12 aa, Mus sp.
GERFEAPEALFQ

SEQ ID NO: 12674 - protein, 11 aa, Mus sp.
AELLNSKLPRW

SEQ ID NO: 12675 - protein, 12 aa, Mus sp.
IVKYELPLVIKA

SEQ ID NO: 12676 - protein, 15 aa, Mus sp.
TPDYIAPEILQGLKY

SEQ ID NO: 12677 - protein, 16 aa, Mus sp.
IPEAQWQSSLARTSSA

SEQ ID NO: 12678 - protein, 17 aa, Mus sp.
VGTARYMAPEVLESRMN

SEQ ID NO: 12679 - protein, 16 aa, Mus sp.
APAQMAYPTAYPSFPG

SEQ ID NO: 12680 - protein, 16 aa, Mus sp.
RITPSYVAFTPEGERL

SEQ ID NO: 12681 - protein, 16 aa, Mus sp.
SFPKFKGSLALRTLDL

SEQ ID NO: 12682 - protein, 18 aa, Mus sp.
VPIYEGYALPHAILRLDL

SEQ ID NO: 12683 - protein, 18 aa, Mus sp.
RPVKESYSGPSTALTYPS

SEQ ID NO: 12684 - protein, 15 aa, Mus sp.
GGSPYIAAKINEAKD

SEQ ID NO: 12685 - protein, 13 aa, Mus sp.
EDFYGSPIPSVSL

SEQ ID NO: 12686 - protein, 17 aa, Mus sp.
DPEDHTVSFVQPNGAIF

SEQ ID NO: 12687 - protein, 19 aa, Mus sp.
HPPQEATNSPKPQPSYEEL

SEQ ID NO: 12688 - protein, 15 aa, Mus sp.
ITDKFWGPSGAESVI

SEQ ID NO: 12689 - protein, 17 aa, Mus sp.
ITKQEYDEAGPSIVHRK

SEQ ID NO: 12690 - protein, 12 aa, Mus sp.
VLAPQVVLSLGG

SEQ ID NO: 12691 - protein, 13 aa, Mus sp.
KFPDWSFPSAWVS

SEQ ID NO: 12692 - protein, 18 aa, Mus sp.
TGMAFRVPTPNVSVVDLT

SEQ ID NO: 12693 - protein, 19 aa, Mus sp.
GDLSWHPALTTKSKMRDPH

SEQ ID NO: 12694 - protein, 16 aa, Mus sp.
SEEEYSAPLPTPAPSS

SEQ ID NO: 12695 - protein, 18 aa, Mus sp.
DVKKPAAAPAPAPAPAPA

SEQ ID NO: 12696 - protein, 20 aa, Mus sp.
VGAGHFRSPHTTEVVGGAPQ

SEQ ID NO: 12697 - protein, 13 aa, Mus sp.
GERFEAPEALFQP

SEQ ID NO: 12698 - protein, 15 aa, Mus sp.
MYKVHNPVPLIVGSS

SEQ ID NO: 12699 - protein, 15 aa, Mus sp.
VEPYEVHNPVPLIVG

SEQ ID NO: 12700 - protein, 14 aa, Mus sp.
VPIYEGYALPHAIL

SEQ ID NO: 12701 - protein, 16 aa, Mus sp.
DHPGNYVEPTIVTGLA

SEQ ID NO: 12702 - protein, 16 aa, Mus sp.
YTIPFYTPIPNGLYPS

SEQ ID NO: 12703 - protein, 14 aa, Mus sp.
STDYGNFLANEASP

SEQ ID NO: 12704 - protein, 18 aa, Mus sp.
GEVKAFFESHPAPSAERT

SEQ ID NO: 12705 - protein, 16 aa, Mus sp.
TPPPAAAPIPAPSTEE

SEQ ID NO: 12706 - protein, 17 aa, Mus sp.
DGKKFKLEAPDADELPR

SEQ ID NO: 12707 - protein, 15 aa, Mus sp.
YALVYTSPVIPELKL

SEQ ID NO: 12708 - protein, 15 aa, Mus sp.
KKAGYITPVPGGVGP

SEQ ID NO: 12709 - protein, 26 aa, Mus sp.
LPNKPTVTVVSPLPNDSINPQPSPDG

SEQ ID NO: 12710 - protein, 16 aa, Mus sp.
QASVATNPIITPVAQE

SEQ ID NO: 12711 - protein, 16 aa, Mus sp.
EEIEVAPPKAHEVRIK

SEQ ID NO: 12712 - protein, 15 aa, Mus sp.
EEDWTISPVPQSIVD

SEQ ID NO: 12713 - protein, 17 aa, Mus sp.
YDPDFLRTAVAQVIGDR

SEQ ID NO: 12714 - protein, 16 aa, Mus sp.
GTPDYIAPEILQGLKY

SEQ ID NO: 12715 - protein, 15 aa, Mus sp.
GVDFIGSTVGLAKVS

SEQ ID NO: 12716 - protein, 13 aa, Mus sp.
HIEVWERPLSNLA

SEQ ID NO: 12717 - protein, 19 aa, Mus sp.
GIDPYDQPNAIYIERHEPF

SEQ ID NO: 12718 - protein, 14 aa, Mus sp.
TARYMAPEVLESRM

SEQ ID NO: 12719 - protein, 16 aa, Mus sp.
MQLTYLPPSPVLAEST

SEQ ID NO: 12720 - protein, 13 aa, Mus sp.
LAWNAPAVLQKPY

SEQ ID NO: 12721 - protein, 19 aa, Mus sp.
GGPGSAVSPYPSFNVSSDV

SEQ ID NO: 12722 - protein, 11 aa, Mus sp.
TIWVSPSPILE

SEQ ID NO: 12723 - protein, 12 aa, Mus sp.
VEPYEVHNPVPL

SEQ ID NO: 12724 - protein, 12 aa, Mus sp.
TPDYIAPEILQG

SEQ ID NO: 12725 - protein, 14 aa, Mus sp.
YASWAANQINRAYQ

SEQ ID NO: 12726 - protein, 17 aa, Mus sp.
DEDIILKAPIAAPEPEL

SEQ ID NO: 12727 - protein, 14 aa, Mus sp.
LPDYTSPVVLPYSR

SEQ ID NO: 12728 - protein, 20 aa, Mus sp.
SKIETLTLAKNYIKSLTATI

SEQ ID NO: 12729 - protein, 16 aa, Mus sp.
GKFIYITPEELAAVAN

SEQ ID NO: 12730 - protein, 15 aa, Mus sp.
EWKDYKAGFGNLERE

SEQ ID NO: 12731 - protein, 15 aa, Mus sp.
MAFRVPTPNVSVVDL

SEQ ID NO: 12732 - protein, 12 aa, Mus sp.
LPYDTPVPGYMN

SEQ ID NO: 12733 - protein, 14 aa, Mus sp.
IVYWMTSQPSDAVR

SEQ ID NO: 12734 - protein, 14 aa, Mus sp.
FYQHPNLMRALGMH

SEQ ID NO: 12735 - protein, 21 aa, Mus sp.
LPEGDISISGPKVNVEAPNVN

SEQ ID NO: 12736 - protein, 17 aa, Mus sp.
INKMDDPTVNWSNERYE

SEQ ID NO: 12737 - protein, 25 aa, Mus sp.
APAPAAPAAAEPQAEAPAAAASSEQ

SEQ ID NO: 12738 - protein, 18 aa, Mus sp.
LRKYHLMQFSEVTKAVSE

SEQ ID NO: 12739 - protein, 9 aa, Mus sp.
KIFEFKETL

SEQ ID NO: 12740 - protein, 16 aa, Mus sp.
AAATTAAPAAAAAPAK

SEQ ID NO: 12741 - protein, 17 aa, Mus sp.
RPALAYESVVAQEGNPI

SEQ ID NO: 12742 - protein, 14 aa, Mus sp.
LPYTASSGLMAPRE

SEQ ID NO: 12743 - protein, 17 aa, Mus sp.
WQPLTWTSSQPSGITVE

SEQ ID NO: 12744 - protein, 19 aa, Mus sp.
GPGGKWMIPPEAKESMDKN

SEQ ID NO: 12745 - protein, 13 aa, Mus sp.
VSSVEAPSVSPAR

SEQ ID NO: 12746 - protein, 15 aa, Mus sp.
IDWTYRPPSSSRTES

SEQ ID NO: 12747 - protein, 18 aa, Mus sp.
SPVSETVVTPEAAPEKNP

SEQ ID NO: 12748 - protein, 16 aa, Mus sp.
VPDDLLYSFPVVIKNK

SEQ ID NO: 12749 - protein, 19 aa, Mus sp.
VGEVKDYEPPFGSKVREHP

SEQ ID NO: 12750 - protein, 14 aa, Mus sp.
APMYYRGAQAAIVV

SEQ ID NO: 12751 - protein, 14 aa, Mus sp.
GTPDYIAPEIIAYQ

SEQ ID NO: 12752 - protein, 14 aa, Mus sp.
ITTDYNSPEAGNIF

SEQ ID NO: 12753 - protein, 18 aa, Mus sp.
IPKVVKSPSSLPAKPLVP

SEQ ID NO: 12754 - protein, 14 aa, Mus sp.
FRVPTPNVSVVDLT

SEQ ID NO: 12755 - protein, 15 aa, Mus sp.
GTPEYLAPEVIQSKG

SEQ ID NO: 12756 - protein, 16 aa, Mus sp.
LAVLEQEPIVLPAWDP

SEQ ID NO: 12757 - protein, 14 aa, Mus sp.
LDIFNLPNVEISKD

SEQ ID NO: 12758 - protein, 15 aa, Mus sp.
SPPPGGYGQPSVLPG

SEQ ID NO: 12759 - protein, 24 aa, Mus sp.
EKWEETELDQLFSGPLPGRLPVNH

SEQ ID NO: 12760 - protein, 15 aa, Mus sp.
KRSNEFDYPSVGQLA

SEQ ID NO: 12761 - protein, 19 aa, Mus sp.
APMPPIIHAPRINVVPMPP

SEQ ID NO: 12762 - protein, 15 aa, Mus sp.
LPANAFASPLQNPDN

SEQ ID NO: 12763 - protein, 14 aa, Mus sp.
AGEFDYSGSQAIKA

SEQ ID NO: 12764 - protein, 11 aa, Mus sp.
ELDYYDSPSVN

SEQ ID NO: 12765 - protein, 14 aa, Mus sp.
DQLEWQSNQPWEQA

SEQ ID NO: 12766 - protein, 15 aa, Mus sp.
YEERVLPSIVNEVLK

SEQ ID NO: 12767 - protein, 15 aa, Mus sp.
AGPQWADPQISESNF

SEQ ID NO: 12768 - protein, 12 aa, Mus sp.
EDRRYNPPIIHQ

SEQ ID NO: 12769 - protein, 19 aa, Mus sp.
VVHKAFVEVNEEGTEAAAA

SEQ ID NO: 12770 - protein, 20 aa, Mus sp.
DGELTYENVQVSPVPGGPPG

SEQ ID NO: 12771 - protein, 15 aa, Mus sp.
SFFWNVAPGAESAVA

SEQ ID NO: 12772 - protein, 16 aa, Mus sp.
ANPDFTQPISEVVDEV

SEQ ID NO: 12773 - protein, 16 aa, Mus sp.
LPAAAQAPDALPAGWE

SEQ ID NO: 12774 - protein, 17 aa, Mus sp.
WSDAAAPFAGLSTDQTL

SEQ ID NO: 12775 - protein, 13 aa, Mus sp.
APMYYRGAQAAIV

SEQ ID NO: 12776 - protein, 17 aa, Mus sp.
EEVNIKTAEAQLAYELQ

SEQ ID NO: 12777 - protein, 17 aa, Mus sp.
FRLWDFRDPSIHSVNVF

SEQ ID NO: 12778 - protein, 17 aa, Mus sp.
RPVFDWKDPLILEEQLT

SEQ ID NO: 12779 - protein, 15 aa, Mus sp.
SSPYNPPDLEEAAKT

SEQ ID NO: 12780 - protein, 16 aa, Mus sp.
IPEQSFYTKPLPGIIM

SEQ ID NO: 12781 - protein, 16 aa, Mus sp.
STLIWAAPRLQSEVAE

SEQ ID NO: 12782 - protein, 14 aa, Mus sp.
AQTAYSANPASQAF

SEQ ID NO: 12783 - protein, 16 aa, Mus sp.
LSIQWESSRPLLASIE

SEQ ID NO: 12784 - protein, 17 aa, Mus sp.
NPTDEYLDAMMNEAPGP

SEQ ID NO: 12785 - protein, 18 aa, Mus sp.
HNNILVSSMLESPINSLY

SEQ ID NO: 12786 - protein, 15 aa, Mus sp.
AFPFESGKPFKIQVL

SEQ ID NO: 12787 - protein, 13 aa, Mus sp.
IVKYELPLVIKAL

SEQ ID NO: 12788 - protein, 18 aa, Mus sp.
VPYPFQWGMPTVSAAGVI

SEQ ID NO: 12789 - protein, 18 aa, Mus sp.
APAPAPAAAPAPAPAAQA

SEQ ID NO: 12790 - protein, 16 aa, Mus sp.
NLRKMGAPEAGMAEYL

SEQ ID NO: 12791 - protein, 17 aa, Mus sp.
ELYRPSFVHPGAATVPT

SEQ ID NO: 12792 - protein, 18 aa, Mus sp.
AANEKAVHADFFNDFEDL

SEQ ID NO: 12793 - protein, 15 aa, Mus sp.
YIEGYVPSQADVAVF

SEQ ID NO: 12794 - protein, 16 aa, Mus sp.
VADKEFHAPLIIDENG

SEQ ID NO: 12795 - protein, 15 aa, Mus sp.
RLEQPNVVISLSRTE

SEQ ID NO: 12796 - protein, 10 aa, Mus sp.
FGIHNGVETL

SEQ ID NO: 12797 - protein, 15 aa, Mus sp.
DTAAKFIGAGAATVG

SEQ ID NO: 12798 - protein, 18 aa, Mus sp.
VPYVEKYRPASASVSALI

SEQ ID NO: 12799 - protein, 18 aa, Mus sp.
GPHSMRYFETAVSRPGLE

SEQ ID NO: 12800 - protein, 15 aa, Mus sp.
WNHRYGEPIPSTTLT

SEQ ID NO: 12801 - protein, 20 aa, Mus sp.
EGPEVDVSLPKANIDVSGPK

SEQ ID NO: 12802 - protein, 13 aa, Mus sp.
LEDFYGSPIPSVS

SEQ ID NO: 12803 - protein, 18 aa, Mus sp.
LNVMRIINEPTAAAIAYG

SEQ ID NO: 12804 - protein, 17 aa, Mus sp.
LTPWLAPIVSEGTFDPE

SEQ ID NO: 12805 - protein, 21 aa, Mus sp.
CALLTLRWPRPLTTLATAVTG

SEQ ID NO: 12806 - protein, 19 aa, Mus sp.
GLNVLRIINEPTAAAIAYG

SEQ ID NO: 12807 - protein, 18 aa, Mus sp.
GNRITPSYVAFTPEGERL

SEQ ID NO: 12808 - protein, 16 aa, Mus sp.
IEFTFERSNTNPSVTV

SEQ ID NO: 12809 - protein, 18 aa, Mus sp.
TPAPTPAATPAASPAPVS

SEQ ID NO: 12810 - protein, 16 aa, Mus sp.
THDLYIQSHISENREE

SEQ ID NO: 12811 - protein, 17 aa, Mus sp.
YVTQFHPPHIEIQMLKN

SEQ ID NO: 12812 - protein, 16 aa, Mus sp.
GPVTPLSPSVLPSLPQ

SEQ ID NO: 12813 - protein, 14 aa, Mus sp.
DEAYVQPEPLGVVL

SEQ ID NO: 12814 - protein, 16 aa, Mus sp.
VKARVANPSGNLTDTY

SEQ ID NO: 12815 - protein, 16 aa, Mus sp.
GNHTLFHNPHVNPLPT

SEQ ID NO: 12816 - protein, 17 aa, Mus sp.
GQDHVDFSQPEPHTVLF

SEQ ID NO: 12817 - protein, 20 aa, Mus sp.
DLYTAKGLFRAAVPSGASTG

SEQ ID NO: 12818 - protein, 15 aa, Mus sp.
DIDSFVPSKAAPAAA

SEQ ID NO: 12819 - protein, 16 aa, Mus sp.
LANMISEPRISYGNDA

SEQ ID NO: 12820 - protein, 8 aa, Mus sp.
AVYSFEAL

SEQ ID NO: 12821 - protein, 19 aa, Mus sp.
FEDYVELPPSVSQAATSPP

SEQ ID NO: 12822 - protein, 15 aa, Mus sp.
DDIRSDWTNPEINKA

SEQ ID NO: 12823 - protein, 15 aa, Mus sp.
IPKLVYHKNIPEWDH

SEQ ID NO: 12824 - protein, 17 aa, Mus sp.
SLEDFYGSPIPSVSLKL

SEQ ID NO: 12825 - protein, 15 aa, Mus sp.
KSKYKASIAALEAKI

SEQ ID NO: 12826 - protein, 14 aa, Mus sp.
VFDVTAPNTFKTLD

SEQ ID NO: 12827 - protein, 15 aa, Mus sp.
TEEKYHEALAKGDVT

SEQ ID NO: 12828 - protein, 11 aa, Mus sp.
RYMAPEVLESR

SEQ ID NO: 12829 - protein, 13 aa, Mus sp.
ATNPIITPVAQEN

SEQ ID NO: 12830 - protein, 18 aa, Mus sp.
LADPSAFAAAAPAAAATT

SEQ ID NO: 12831 - protein, 16 aa, Mus sp.
QRYSYQYTVANKEYVA

SEQ ID NO: 12832 - protein, 14 aa, Mus sp.
LVLDFVTPTPLGTR

SEQ ID NO: 12833 - protein, 19 aa, Mus sp.
APGKKVIYSQPSTRSEGEF

SEQ ID NO: 12834 - protein, 16 aa, Mus sp.
TITVYSFPESVELRPL

SEQ ID NO: 12835 - protein, 17 aa, Mus sp.
TPTDVTHHPIPSEEDIN

SEQ ID NO: 12836 - protein, 17 aa, Mus sp.
VRIDQYQGADAVGLEEK

SEQ ID NO: 12837 - protein, 16 aa, Mus sp.
KTLAYLFSGAAAAAEA

SEQ ID NO: 12838 - protein, 15 aa, Mus sp.
DVNTYNAAIAYTIVS

SEQ ID NO: 12839 - protein, 17 aa, Mus sp.
IDPYDQPNAIYIERHEP

SEQ ID NO: 12840 - protein, 30 aa, Mus sp.; identical to SEQ ID NO: 1868

SEQ ID NO: 12841 - protein, 14 aa, Mus sp.
NLDYVATSIHEAVT

SEQ ID NO: 12842 - protein, 13 aa, Mus sp.
DPYDQPNAIYIER

SEQ ID NO: 12843 - protein, 14 aa, Mus sp.
ADDTYTESYISTIG

SEQ ID NO: 12844 - protein, 15 aa, Mus sp.
SKNVFLSPMSISSAL

SEQ ID NO: 12845 - protein, 17 aa, Mus sp.
GPGLDFEGPDAKLSGPN

SEQ ID NO: 12846 - protein, 17 aa, Mus sp.
EDWPTFLNPNVDKAGPA

SEQ ID NO: 12847 - protein, 17 aa, Mus sp.
WQGGVYASPSIAGSRPG

SEQ ID NO: 12848 - protein, 14 aa, Mus sp.
FPIKWTAPEAALFG

SEQ ID NO: 12849 - protein, 16 aa, Mus sp.
FNLDAEAPAVLSGPPG

SEQ ID NO: 12850 - protein, 17 aa, Mus sp.
GNPLNSVFVAPAVTPVK

SEQ ID NO: 12851 - protein, 19 aa, Mus sp.
SDMNDAYLGYASAVILRNR

SEQ ID NO: 12852 - protein, 17 aa, Mus sp.
AANVYTTVVAELVRGGQ

SEQ ID NO: 12853 - protein, 22 aa, Mus sp.
EEKYHEALAKGDVTTQVALQPA

SEQ ID NO: 12854 - protein, 15 aa, Mus sp.
IEGYVPSQADVAVFE

SEQ ID NO: 12855 - protein, 14 aa, Mus sp.
VGDIFSNPEAVLAK

SEQ ID NO: 12856 - protein, 14 aa, Mus sp.
TGMAFRVPTPNVSV

SEQ ID NO: 12857 - protein, 19 aa, Mus sp.
GVPDDLLYSFPVVIKNKTW

SEQ ID NO: 12858 - protein, 15 aa, Mus sp.
VAVNWYAPLVAPISK

SEQ ID NO: 12859 - protein, 21 aa, Mus sp.
ITVKELFTTPVLRASVSSPFP

SEQ ID NO: 12860 - protein, 21 aa, Mus sp.
KNVSINTVTYEWAPPVQNQAL

SEQ ID NO: 12861 - protein, 16 aa, Mus sp.
VDRVLKSPVASIVYEL

SEQ ID NO: 12862 - protein, 15 aa, Mus sp.
GDSYRSPWSNKYDPP

SEQ ID NO: 12863 - protein, 21 aa, Mus sp.
GTPEYIAPEVIFRQGYGKPVD

SEQ ID NO: 12864 - protein, 17 aa, Mus sp.
EIKVYWDAPSPAPDHIR

SEQ ID NO: 12865 - protein, 15 aa, Mus sp.
NLKHVAGAAAAGAVV

SEQ ID NO: 12866 - protein, 15 aa, Mus sp.
DTRFVAPGALGNAPW

SEQ ID NO: 12867 - protein, 22 aa, Mus sp.
IEKDPAKGRIYQGTEADSIFSG

SEQ ID NO: 12868 - protein, 20 aa, Mus sp.
GPHSMRYFETAVSRPGLEEP

SEQ ID NO: 12869 - protein, 14 aa, Mus sp.
EVGEYRQPSGGSVP

SEQ ID NO: 12870 - protein, 16 aa, Mus sp.
EAPAAAEAPAAAEAPA

SEQ ID NO: 12871 - protein, 19 aa, Mus sp.
EEKPVPAAPVPSPVAPAPV

SEQ ID NO: 12872 - protein, 13 aa, Mus sp.
TARYMAPEVLESR

SEQ ID NO: 12873 - protein, 19 aa, Mus sp.
VPEESSSFEGAQVEHSTSR

SEQ ID NO: 12874 - protein, 23 aa, Mus sp.
IQEMEKEDRRYNPPIIHQGFQDT

SEQ ID NO: 12875 - protein, 16 aa, Mus sp.
SAPPHFHFGQTNRTPE

SEQ ID NO: 12876 - protein, 13 aa, Mus sp.
DIYVWRGAQATLS

SEQ ID NO: 12877 - protein, 15 aa, Mus sp.
GTPYWMSPEVISGEG

SEQ ID NO: 12878 - protein, 16 aa, Mus sp.
YLLSQSSPAPLTAAEE

SEQ ID NO: 12879 - protein, 14 aa, Mus sp.
REGSYEAAKILLDH

SEQ ID NO: 12880 - protein, 14 aa, Mus sp.
SLEDFYGSPIPSVS

SEQ ID NO: 12881 - protein, 16 aa, Mus sp.
TKGNPARWRDFHSATM

SEQ ID NO: 12882 - protein, 16 aa, Mus sp.
DDNVFVPPESLQEEDE

SEQ ID NO: 12883 - protein, 15 aa, Mus sp.
VTEYTPRSWNFLHTL

SEQ ID NO: 12884 - protein, 17 aa, Mus sp.
SPLVHVLMGNVYILFPP

SEQ ID NO: 12885 - protein, 13 aa, Mus sp.
APDMVYLGSMTNF

SEQ ID NO: 12886 - protein, 17 aa, Mus sp.
EGPEASTPMPSPSPSPS

SEQ ID NO: 12887 - protein, 17 aa, Mus sp.
DSGGFYISPRSTFSSLQ

SEQ ID NO: 12888 - protein, 16 aa, Mus sp.
GNLDYWTYPGSLTTPP

SEQ ID NO: 12889 - protein, 16 aa, Mus sp.
TPRDYYFALAHTVRDH

SEQ ID NO: 12890 - protein, 17 aa, Mus sp.
EAQVEFMASHGNEAARA

SEQ ID NO: 12891 - protein, 18 aa, Mus sp.
DWQGGVYASPSIAGSRPG

SEQ ID NO: 12892 - protein, 16 aa, Mus sp.
ITPSYYTTSDAVISTE

SEQ ID NO: 12893 - protein, 18 aa, Mus sp.
DYVELPPSVSQAATSPPG

SEQ ID NO: 12894 - protein, 15 aa, Mus sp.
RITPSYVAFTPEGER

SEQ ID NO: 12895 - protein, 15 aa, Mus sp.
GYPVLYPTGWSSSDN

SEQ ID NO: 12896 - protein, 13 aa, Mus sp.
AGNFYVPAEPKLA

SEQ ID NO: 12897 - protein, 15 aa, Mus sp.
VPTVPLLPPQVNQSL

SEQ ID NO: 12898 - protein, 14 aa, Mus sp.
VEALEQPAPAIVSA

SEQ ID NO: 12899 - protein, 24 aa, Mus sp.
ITGLDPAGPNFEYAEAPSRLSPDD

SEQ ID NO: 12900 - protein, 12 aa, Mus sp.
DPYDQPNAIYIE

SEQ ID NO: 12901 - protein, 14 aa, Mus sp.
EDRRYNPPIIHQGF

SEQ ID NO: 12902 - protein, 18 aa, Mus sp.
GKLLEAKGPVTDVAYSHD

SEQ ID NO: 12903 - protein, 19 aa, Mus sp.
FIHKSVVEVNEEGTEAAAA

SEQ ID NO: 12904 - protein, 17 aa, Mus sp.
TKVEPYEVHNPVPLIVG

SEQ ID NO: 12905 - protein, 17 aa, Mus sp.
VPKHEYTYPYVDSSDFG

SEQ ID NO: 12906 - protein, 16 aa, Mus sp.
VTNLRKMGAPEAGMAE

SEQ ID NO: 12907 - protein, 14 aa, Mus sp.
NQLEALVGPEANVG

SEQ ID NO: 12908 - protein, 14 aa, Mus sp.
KQREEYQPATPGLG

SEQ ID NO: 12909 - protein, 16 aa, Mus sp.
FLKKWETPSQNTAQLD

SEQ ID NO: 12910 - protein, 15 aa, Mus sp.
NPPSYYTQPVPVPNA

SEQ ID NO: 12911 - protein, 16 aa, Mus sp.
SSPEFKGSQASLSDSL

SEQ ID NO: 12912 - protein, 17 aa, Mus sp.
IPSPGLMVFPKPQTALE

SEQ ID NO: 12913 - protein, 18 aa, Mus sp.
AGEFDYSGSQAIKALKEE

SEQ ID NO: 12914 - protein, 16 aa, Mus sp.
VDVFYSSGIPATARPY

SEQ ID NO: 12915 - protein, 13 aa, Mus sp.
FPQYTAPSILPSD

SEQ ID NO: 12916 - protein, 18 aa, Mus sp.
GEEAGAYDGPRTADGIVS

SEQ ID NO: 12917 - protein, 15 aa, Mus sp.
VFDVTAPNTFKTLDS

SEQ ID NO: 12918 - protein, 17 aa, Mus sp.
DDLPTTFQGATASTSYG

SEQ ID NO: 12919 - protein, 18 aa, Mus sp.
MRTSVDQNVYPSQNGTPN

SEQ ID NO: 12920 - protein, 16 aa, Mus sp.
IFGTHHNPAVWPDPEV

SEQ ID NO: 12921 - protein, 15 aa, Mus sp.
SNLLLQSPGVLTAAR

SEQ ID NO: 12922 - protein, 15 aa, Mus sp.
FPYEGPAPLEAIANG

SEQ ID NO: 12923 - protein, 12 aa, Mus sp.
DYVATSIHEAVT

SEQ ID NO: 12924 - protein, 15 aa, Mus sp.
SEEEYSAPLPTPAPS

SEQ ID NO: 12925 - protein, 15 aa, Mus sp.
GGKDFNMPLTISSLK

SEQ ID NO: 12926 - protein, 15 aa, Mus sp.
GPKVNVEAPNVNMEG

SEQ ID NO: 12927 - protein, 14 aa, Mus sp.
IEQSWGSPKVTKDG

SEQ ID NO: 12928 - protein, 15 aa, Mus sp.
LENPHQPASLEATDS

SEQ ID NO: 12929 - protein, 8 aa, Mus sp.
ASYEFTTL

SEQ ID NO: 12930 - protein, 17 aa, Mus sp.
VAPKETTIWVSPSPILE

SEQ ID NO: 12931 - protein, 15 aa, Mus sp.
DGDSYRSPWSNKYDP

SEQ ID NO: 12932 - protein, 15 aa, Mus sp.
SVAFIKPGVNKAEVT

SEQ ID NO: 12933 - protein, 17 aa, Mus sp.
GDSNFGAPSASVAAAPA

SEQ ID NO: 12934 - protein, 14 aa, Mus sp.
GAPFDWEGAQASQA

SEQ ID NO: 12935 - protein, 15 aa, Mus sp.
GYAVYETPTAHNGAK

SEQ ID NO: 12936 - protein, 20 aa, Mus sp.
GSNLSINTNQNINIKSEPIS

SEQ ID NO: 12937 - protein, 18 aa, Mus sp.
DTPTDVTHHPIPSEEDIN

SEQ ID NO: 12938 - protein, 18 aa, Mus sp.
TDINAFVGAVSLTAADSN

SEQ ID NO: 12939 - protein, 15 aa, Mus sp.
LNLDWQYPGSRGSPP

SEQ ID NO: 12940 - protein, 15 aa, Mus sp.
KSIYRYDLASGATEQ

SEQ ID NO: 12941 - protein, 14 aa, Mus sp.
DFYGSPIPSVSLKL

SEQ ID NO: 12942 - protein, 16 aa, Mus sp.
SQELVRAPTAALSPEP

SEQ ID NO: 12943 - protein, 15 aa, Mus sp.
LEKAVYQGPGSSPVK

SEQ ID NO: 12944 - protein, 16 aa, Mus sp.
VLPTYDASKVTASGPG

SEQ ID NO: 12945 - protein, 14 aa, Mus sp.
TPYYVAPEVLGPEK

SEQ ID NO: 12946 - protein, 16 aa, Mus sp.
VYTRYHCSLPVPEPSA

SEQ ID NO: 12947 - protein, 18 aa, Mus sp.
EDITHTYKYPEGSPEERE

SEQ ID NO: 12948 - protein, 13 aa, Mus sp.
SKNVFLSPMSISS

SEQ ID NO: 12949 - protein, 19 aa, Mus sp.
INTVTYEWAPPVQNQALAR

SEQ ID NO: 12950 - protein, 20 aa, Mus sp.
GFPKPPSYNVATTLPSYDEA

SEQ ID NO: 12951 - protein, 15 aa, Mus sp.
GGERFEAPEALFQPH

SEQ ID NO: 12952 - protein, 17 aa, Mus sp.
EAIETIVAAMSNLVPPV

SEQ ID NO: 12953 - protein, 15 aa, Mus sp.
REGSYEAAKILLDHF

SEQ ID NO: 12954 - protein, 16 aa, Mus sp.
KEFEFIESQTSSHRIN

SEQ ID NO: 12955 - protein, 13 aa, Mus sp.
DEATRYLAPTILT

SEQ ID NO: 12956 - protein, 14 aa, Mus sp.
IQWESSRPLLASIE

SEQ ID NO: 12957 - protein, 21 aa, Mus sp.
GPHSMRYFETAVSRPGLEEPR

SEQ ID NO: 12958 - protein, 16 aa, Mus sp.
GPNFEYAEAPSRLSPD

SEQ ID NO: 12959 - protein, 15 aa, Mus sp.
VPPVFTQPTANIMPS

SEQ ID NO: 12960 - protein, 13 aa, Mus sp.
EVSSVEAPSVSPA

SEQ ID NO: 12961 - protein, 17 aa, Mus sp.
IWRDYVPPTANLDQKDK

SEQ ID NO: 12962 - protein, 15 aa, Mus sp.
DDDVYRAPPIDRSIL

SEQ ID NO: 12963 - protein, 20 aa, Mus sp.
GPPGFEDYVELPPSVSQAAK

SEQ ID NO: 12964 - protein, 17 aa, Mus sp.
FGKWKYEKPDGSPVFIA

SEQ ID NO: 12965 - protein, 13 aa, Mus sp.
RYNPPIIHQGFQD

SEQ ID NO: 12966 - protein, 19 aa, Mus sp.
DPAKGRIYQGTEADSIFSG

SEQ ID NO: 12967 - protein, 17 aa, Mus sp.
STQLIRNGDWTFQVLVM

SEQ ID NO: 12968 - protein, 17 aa, Mus sp.
DFLKKWETPSQNTAQLD

SEQ ID NO: 12969 - protein, 14 aa, Mus sp.
SFFWNVAPGAESAV

SEQ ID NO: 12970 - protein, 8 aa, Mus sp.
PKISTSLP

SEQ ID NO: 12971 - protein, 15 aa, Mus sp.
LTLMMPYYKLHPESP

SEQ ID NO: 12972 - protein, 15 aa, Mus sp.
YHFVTPLTSMVVTKP

SEQ ID NO: 12973 - protein, 16 aa, Mus sp.
ITNQYNSPTGLYSSEN

SEQ ID NO: 12974 - protein, 15 aa, Mus sp.
FDIFYTAPQPGKYVI

SEQ ID NO: 12975 - protein, 15 aa, Mus sp.
SPYAFNGGTVLAIAG

SEQ ID NO: 12976 - protein, 16 aa, Mus sp.
LDNYLTSPLPEEVDET

SEQ ID NO: 12977 - protein, 24 aa, Mus sp.
GDEDLETKKFRFEEPVVLPDLSDQ

SEQ ID NO: 12978 - protein, 16 aa, Mus sp.
TVIHFNNPKVQASLAA

SEQ ID NO: 12979 - protein, 16 aa, Mus sp.
FSFGKINPHYTVKGLE

SEQ ID NO: 12980 - protein, 15 aa, Mus sp.
APSWHASVPTRAGPD

SEQ ID NO: 12981 - protein, 16 aa, Mus sp.
GPASEWTFSTPEGVPG

SEQ ID NO: 12982 - protein, 14 aa, Mus sp.
ALDTFNTSLVTPIY

SEQ ID NO: 12983 - protein, 18 aa, Mus sp.
GTVIHFNNPKVQASLAAN

SEQ ID NO: 12984 - protein, 12 aa, Mus sp.
VAFNGPKGGYVA

SEQ ID NO: 12985 - protein, 18 aa, Mus sp.
KLTGMAFRVPTPNVSVVD

SEQ ID NO: 12986 - protein, 19 aa, Mus sp.
SFSGALGVPSFVVPSSGPG

SEQ ID NO: 12987 - protein, 12 aa, Mus sp.
LPYKSPGINVDS

SEQ ID NO: 12988 - protein, 28 aa, Mus sp.
MQNLGMTSPLPFDSLGYNASHHPFAGYP

SEQ ID NO: 12989 - protein, 16 aa, Mus sp.
SPKVTYKAPVPTGEVY

SEQ ID NO: 12990 - protein, 22 aa, Mus sp.
VDHNTRTTTWQRPTAEYVRNYE

SEQ ID NO: 12991 - protein, 16 aa, Mus sp.
VTVVSPLPNDSINPQP

SEQ ID NO: 12992 - protein, 17 aa, Mus sp.
LTVTPWKAPIVWEGTYD

SEQ ID NO: 12993 - protein, 16 aa, Mus sp.
VKFKSFCLKHSQNKPK

SEQ ID NO: 12994 - protein, 20 aa, Mus sp.
DDGTVIHFNNPKVQASLSAN

SEQ ID NO: 12995 - protein, 16 aa, Mus sp.
LPKEWLTPAALQSSVS

SEQ ID NO: 12996 - protein, 13 aa, Mus sp.
LALPYDTPVPGYM

SEQ ID NO: 12997 - protein, 21 aa, Mus sp.
EPSPVSETVVTPEAAPEKNPV

SEQ ID NO: 12998 - protein, 17 aa, Mus sp.
KPNGIFKGPTAENAEYL

SEQ ID NO: 12999 - protein, 17 aa, Mus sp.
GSTLWSSPLPEEAQDVT

SEQ ID NO: 13000 - protein, 16 aa, Mus sp.
LLAETVAPAVRGANPH

SEQ ID NO: 13001 - protein, 23 aa, Mus sp.
DPTSVTLKPMEIRTFLASVQWQE

SEQ ID NO: 13002 - protein, 16 aa, Mus sp.
QIYYAGPVNNPGLDVP

SEQ ID NO: 13003 - protein, 24 aa, Mus sp.
APAAPAAAEPQAEAPAAAASSEQS

SEQ ID NO: 13004 - protein, 15 aa, Mus sp.
DGNFVEATALHTAPH

SEQ ID NO: 13005 - protein, 16 aa, Mus sp.
TAKGLFRAAVPSGAST

SEQ ID NO: 13006 - protein, 15 aa, Mus sp.
ALLLNAPVVSITQGR

SEQ ID NO: 13007 - protein, 17 aa, Mus sp.
SSPDIFDSPSPEEDKEE

SEQ ID NO: 13008 - protein, 16 aa, Mus sp.
EDNVYHSSNAVYRAPS

SEQ ID NO: 13009 - protein, 22 aa, Mus sp.
GSKVDFVAWATGEPNFANDDEN

SEQ ID NO: 13010 - protein, 17 aa, Mus sp.
AAPASAPTPSTPAPTPA

SEQ ID NO: 13011 - protein, 14 aa, Mus sp.
IEFRGPNGLLVYQG

SEQ ID NO: 13012 - protein, 16 aa, Mus sp.
IPETYPFNPPKVRFIT

SEQ ID NO: 13013 - protein, 14 aa, Mus sp.
DQKFYNFVVIHARA

SEQ ID NO: 13014 - protein, 20 aa, Mus sp.
EPSKLKRSYSSPDITQALQE

SEQ ID NO: 13015 - protein, 14 aa, Mus sp.
KEDRRYNPPIIHQG

SEQ ID NO: 13016 - protein, 24 aa, Mus sp.
APAPAAPAAAEPQAEAPAAAASSE

SEQ ID NO: 13017 - protein, 17 aa, Mus sp.
TPENEDLHAATVNPDPS

SEQ ID NO: 13018 - protein, 10 aa, Mus sp.
ALPKAVVKLD

SEQ ID NO: 13019 - protein, 13 aa, Mus sp.
FDFAGPAIHGSAV

SEQ ID NO: 13020 - protein, 18 aa, Mus sp.
VPDVQFKTPQISMSDIDL

SEQ ID NO: 13021 - protein, 15 aa, Mus sp.
TIEFRGPNGLLVYQG

SEQ ID NO: 13022 - protein, 11 aa, Mus sp.
TIPFYTPIPNG

SEQ ID NO: 13023 - protein, 18 aa, Mus sp.
HPAPPVASSPTVIPGEPR

SEQ ID NO: 13024 - protein, 20 aa, Mus sp.
LEALGHMFMYFLRGSLPWQG

SEQ ID NO: 13025 - protein, 15 aa, Mus sp.
IPKVVKSPSSLPAKP

SEQ ID NO: 13026 - protein, 11 aa, Mus sp.
DIEADHVGTYG

SEQ ID NO: 13027 - protein, 15 aa, Mus sp.
LRIINEPTAAAIAYG

SEQ ID NO: 13028 - protein, 15 aa, Mus sp.
ETVAYLQAHALTTEG

SEQ ID NO: 13029 - protein, 15 aa, Mus sp.
RDNMFSGSKINYTEN

SEQ ID NO: 13030 - protein, 16 aa, Mus sp.
PNENCLKQIAVSSVPS

SEQ ID NO: 13031 - protein, 16 aa, Mus sp.
LSLKYHFVTPLTSMVV

SEQ ID NO: 13032 - protein, 16 aa, Mus sp.
FGTGHSAPSASPAFGA

SEQ ID NO: 13033 - protein, 20 aa, Mus sp.
LEDPDGFSWPATLPSVYKQP

SEQ ID NO: 13034 - protein, 17 aa, Mus sp.
EEWGPFKAPHANRFIFS

SEQ ID NO: 13035 - protein, 21 aa, Mus sp.
EKPVPAAPVPSPVAPAPVPSR

SEQ ID NO: 13036 - protein, 14 aa, Mus sp.
KPFQNPVPNQSPSS

SEQ ID NO: 13037 - protein, 14 aa, Mus sp.
KSLTIQPDPIVVPG

SEQ ID NO: 13038 - protein, 18 aa, Mus sp.
GPDGRFVMGPTVAPSQEK

SEQ ID NO: 13039 - protein, 17 aa, Mus sp.
VPPSVSPSPATAFSGPP

SEQ ID NO: 13040 - protein, 15 aa, Mus sp.
ISKQEYDESGPSIVH

SEQ ID NO: 13041 - protein, 16 aa, Mus sp.
KPIIWAEPGSVIAAYT

SEQ ID NO: 13042 - protein, 17 aa, Mus sp.
GKKVIYSQPSTRSEGEF

SEQ ID NO: 13043 - protein, 26 aa, Mus sp.
YPPPPQSDSASSPSPSFSEDNLPPPP

SEQ ID NO: 13044 - protein, 16 aa, Mus sp.
SNKQYLFPETLVIGEK

SEQ ID NO: 13045 - protein, 13 aa, Mus sp.
TNPIITPVAQENQ

SEQ ID NO: 13046 - protein, 15 aa, Mus sp.
GMAFRVPTPNVSVVD

SEQ ID NO: 13047 - protein, 15 aa, Mus sp.
YPNQVYYRPVDQYSN

SEQ ID NO: 13048 - protein, 18 aa, Mus sp.
AQRAGYKAAIVHNVDSDD

SEQ ID NO: 13049 - protein, 17 aa, Mus sp.
PTLDHYKEPSAIFQLPY

SEQ ID NO: 13050 - protein, 16 aa, Mus sp.
YPHIVVGALAASAPIW

SEQ ID NO: 13051 - protein, 23 aa, Mus sp.
APAATDEAAASAAPAASPEPQPE

SEQ ID NO: 13052 - protein, 15 aa, Mus sp.
RERYNFPNPNPFVED

SEQ ID NO: 13053 - protein, 15 aa, Mus sp.
NLRDNYRFAHTNIES

SEQ ID NO: 13054 - protein, 13 aa, Mus sp.
LGEFDTPEAIWSS

SEQ ID NO: 13055 - protein, 15 aa, Mus sp.
LPPVSPPKAALSVDE

SEQ ID NO: 13056 - protein, 14 aa, Mus sp.
ESKVVVPPLPGKAF

SEQ ID NO: 13057 - protein, 15 aa, Mus sp.
VGDLYTDPQIHTEKG

SEQ ID NO: 13058 - protein, 25 aa, Mus sp.
FPGPNIGGDTHFDSAEPWTVQNEDL

SEQ ID NO: 13059 - protein, 14 aa, Mus sp.
LQPSGQLVSPRPAG

SEQ ID NO: 13060 - protein, 15 aa, Mus sp.
EDTVTISGPQAAVNE

SEQ ID NO: 13061 - protein, 15 aa, Mus sp.
QYPNFAGPQAALANK

SEQ ID NO: 13062 - protein, 16 aa, Mus sp.
EKYVTSAPMPEPGAPG

SEQ ID NO: 13063 - protein, 17 aa, Mus sp.
DHDVKIWAPTAEASTEL

SEQ ID NO: 13064 - protein, 14 aa, Mus sp.
GPKPFSAPKPQTSP

SEQ ID NO: 13065 - protein, 15 aa, Mus sp.
VQLVEYEASAAGLIR

SEQ ID NO: 13066 - protein, 14 aa, Mus sp.
YNEVHSPSVAVEMG

SEQ ID NO: 13067 - protein, 17 aa, Mus sp.
IGNERFRCPEAIFQPSF

SEQ ID NO: 13068 - protein, 16 aa, Mus sp.
LQSTDYGNFLANEASP

SEQ ID NO: 13069 - protein, 18 aa, Mus sp.
LVTEDNVFEAPTLVKVFK

SEQ ID NO: 13070 - protein, 13 aa, Mus sp.
TVIHFNNPKVQAS

SEQ ID NO: 13071 - protein, 12 aa, Mus sp.
IAWESPQGQVSR

SEQ ID NO: 13072 - protein, 18 aa, Mus sp.
EKTGQEYKPGNPSAAAVQ

SEQ ID NO: 13073 - protein, 21 aa, Mus sp.
DDGHGGYKPFQNPVPNQSPSS

SEQ ID NO: 13074 - protein, 17 aa, Mus sp.
VNKGFYKEATQLWGKAE

SEQ ID NO: 13075 - protein, 14 aa, Mus sp.
LAWNAPAVLQKPYN

SEQ ID NO: 13076 - protein, 16 aa, Mus sp.
SIKEKYNSFWIGLSYT

SEQ ID NO: 13077 - protein, 14 aa, Mus sp.
DVDFDFAGPAIHGS

SEQ ID NO: 13078 - protein, 15 aa, Mus sp.
LPETFRRPQIDPAVE

SEQ ID NO: 13079 - protein, 16 aa, Mus sp.
KELEEQLGPVAEETRA

SEQ ID NO: 13080 - protein, 16 aa, Mus sp.
NLDYVATSIHEAVTKI

SEQ ID NO: 13081 - protein, 17 aa, Mus sp.
KDIDSFVPSKAAPAAAA

SEQ ID NO: 13082 - protein, 16 aa, Mus sp.
VGGERFEAPEALFQPH

SEQ ID NO: 13083 - protein, 15 aa, Mus sp.
VDPYEEADAQIAQER

SEQ ID NO: 13084 - protein, 15 aa, Mus sp.
QLEALVGPEANVGPY

SEQ ID NO: 13085 - protein, 21 aa, Mus sp.
QDPEDHTVSFVQPNGAIFEPS

SEQ ID NO: 13086 - protein, 14 aa, Mus sp.
DFVAWATGEPNFAN

SEQ ID NO: 13087 - protein, 15 aa, Mus sp.
ASLEDFYGSPIPSVS

SEQ ID NO: 13088 - protein, 18 aa, Mus sp.
TPIPQSGSPFPASVQDPG

SEQ ID NO: 13089 - protein, 14 aa, Mus sp.
EEKYHEALAKGDVT

SEQ ID NO: 13090 - protein, 13 aa, Mus sp.
DQLFSGPLPGRLP

SEQ ID NO: 13091 - protein, 18 aa, Mus sp.
ASLEDFYGSPIPSVSLKL

SEQ ID NO: 13092 - protein, 16 aa, Mus sp.
LIDQCSHFEESLIKNL

SEQ ID NO: 13093 - protein, 17 aa, Mus sp.
CFPPSERFMKYLLNFIS

SEQ ID NO: 13094 - protein, 15 aa, Mus sp.
GIFQYQQALANMQLQ

SEQ ID NO: 13095 - protein, 17 aa, Mus sp.
APDTRFVAPGALGNAPW

SEQ ID NO: 13096 - protein, 17 aa, Mus sp.
DEQEFVYKEPAITKLPE

SEQ ID NO: 13097 - protein, 14 aa, Mus sp.
SPNYAAPEVISGRL

SEQ ID NO: 13098 - protein, 13 aa, Mus sp.
GVDFIGSTVGLAK

SEQ ID NO: 13099 - protein, 15 aa, Mus sp.
KDGYQMAQPVFAPKN

SEQ ID NO: 13100 - protein, 14 aa, Mus sp.
ADDIVGPVTHEIFE

SEQ ID NO: 13101 - protein, 15 aa, Mus sp.
VNSQYQEPDIIIHFA

SEQ ID NO: 13102 - protein, 13 aa, Mus sp.
YQMYGGPVVLVAH

SEQ ID NO: 13103 - protein, 15 aa, Mus sp.
DIRSDWTNPEINKAV

SEQ ID NO: 13104 - protein, 16 aa, Mus sp.
AEQEVLAPQVVLSLGG

SEQ ID NO: 13105 - protein, 11 aa, Mus sp.
KYSVWIGGSIL

SEQ ID NO: 13106 - protein, 21 aa, Mus sp.
GSKVDFVAWATGEPNFANDDE

SEQ ID NO: 13107 - protein, 19 aa, Mus sp.
HDGDSVVFAGPAGNSVETR

SEQ ID NO: 13108 - protein, 18 aa, Mus sp.
KEDRRYNPPIIHQGFQDT

SEQ ID NO: 13109 - protein, 18 aa, Mus sp.
ESLHLRFSAPQIENEPET

SEQ ID NO: 13110 - protein, 12 aa, Mus sp.
TENGYSYPVVSY

SEQ ID NO: 13111 - protein, 13 aa, Mus sp.
VDFDFAGPAIHGS

SEQ ID NO: 13112 - protein, 26 aa, Mus sp.
DYKDESGFPKPPSYNVATTLPSYDEA

SEQ ID NO: 13113 - protein, 16 aa, Mus sp.
TSSYYRGAHGIIVVYD

SEQ ID NO: 13114 - protein, 16 aa, Mus sp.
HIEVWERPLSNLAWAV

SEQ ID NO: 13115 - protein, 16 aa, Mus sp.
TPERLNSPVTIPAVMF

SEQ ID NO: 13116 - protein, 15 aa, Mus sp.
LPSTSYLPSTPSVVP

SEQ ID NO: 13117 - protein, 17 aa, Mus sp.
SARTVITPDPNLSIDQV

SEQ ID NO: 13118 - protein, 17 aa, Mus sp.
NDLQYAAPGGLIGVGTK

SEQ ID NO: 13119 - protein, 16 aa, Mus sp.
TWSDAAAPFAGLSTDQ

SEQ ID NO: 13120 - protein, 16 aa, Mus sp.
EPPSDLDFFSPRPVPA

SEQ ID NO: 13121 - protein, 14 aa, Mus sp.
LFPQYTAPSILPSD

SEQ ID NO: 13122 - protein, 16 aa, Mus sp.
EYFVFRPGTIEQAVEE

SEQ ID NO: 13123 - protein, 12 aa, Mus sp.
VGGERFEAPEAL

SEQ ID NO: 13124 - protein, 15 aa, Mus sp.
PGKTSRLYQTFYLNT

SEQ ID NO: 13125 - protein, 18 aa, Mus sp.
LKWKALYTDPKSSETAAF

SEQ ID NO: 13126 - protein, 18 aa, Mus sp.
KPKGQLPDYTSPVVLPYS

SEQ ID NO: 13127 - protein, 17 aa, Mus sp.
EDITHTYKYPEGSPEER

SEQ ID NO: 13128 - protein, 15 aa, Mus sp.
VGTKRYMAPEVLDDS

SEQ ID NO: 13129 - protein, 17 aa, Mus sp.
DVKKPAAAPAPAPAPAP

SEQ ID NO: 13130 - protein, 15 aa, Mus sp.
WKALYTDPKSSETAA

SEQ ID NO: 13131 - protein, 17 aa, Mus sp.
GGLPDYSAPNPIKVTHR

SEQ ID NO: 13132 - protein, 18 aa, Mus sp.
VPDDLLYSFPVVIKNKTW

SEQ ID NO: 13133 - protein, 15 aa, Mus sp.
VTQFHPPHIEIQMLK

SEQ ID NO: 13134 - protein, 12 aa, Mus sp.
RYNPPIIHQGFQ

SEQ ID NO: 13135 - protein, 17 aa, Mus sp.
TVLEMYKVHNPVPLIVG

SEQ ID NO: 13136 - protein, 20 aa, Mus sp.
QPTGPPPYHESLAGASQPPY

SEQ ID NO: 13137 - protein, 21 aa, Mus sp.
DPGESKSYSYSEVLPTEGPPS

SEQ ID NO: 13138 - protein, 15 aa, Mus sp.
APAAAEAPAAAEAPA

SEQ ID NO: 13139 - protein, 16 aa, Mus sp.
YYNEVHSPSVAVEMGM

SEQ ID NO: 13140 - protein, 21 aa, Mus sp.
APSEERVYMVGKANSVFEDLS

SEQ ID NO: 13141 - protein, 20 aa, Mus sp.
GVPVPGSPFPLEAVAPTKPS

SEQ ID NO: 13142 - protein, 14 aa, Mus sp.
GSPYIAAKINEAKD

SEQ ID NO: 13143 - protein, 26 aa, Mus sp.
IPISKVKDVYVITDQIPVFVTMSQKN

SEQ ID NO: 13144 - protein, 14 aa, Mus sp.
GVDFIGSTVGLAKV

SEQ ID NO: 13145 - protein, 18 aa, Mus sp.
YDRALAVVYSVITPFLNP

SEQ ID NO: 13146 - protein, 26 aa, Mus sp.
KDAGTIAGLNVLRIINEPTAAAIAYG

SEQ ID NO: 13147 - protein, 15 aa, Mus sp.
LQQEFQRAQAAKAPG

SEQ ID NO: 13148 - protein, 15 aa, Mus sp.
EKQGFHSGTPAASFN

SEQ ID NO: 13149 - protein, 16 aa, Mus sp.
TPEYLAPEIILSKGYN

SEQ ID NO: 13150 - protein, 15 aa, Mus sp.
DVYVFLGPEPKSVVQ

SEQ ID NO: 13151 - protein, 16 aa, BOVIN
AVPDAAGPTPSAAGPP

SEQ ID NO: 13152 - protein, 16 aa, Mus sp.
ENLYPYLGPSTLRDRP

SEQ ID NO: 13153 - protein, 17 aa, Mus sp.
LDLLQQRAPVPASTSVL

SEQ ID NO: 13154 - protein, 15 aa, Mus sp.
TKVVFLSPAVPEEPE

SEQ ID NO: 13155 - protein, 16 aa, Mus sp.
EAINDYKGAVIVVSHD

SEQ ID NO: 13156 - protein, 16 aa, Mus sp.
APDAWDYSQGFVNEEM

SEQ ID NO: 13157 - protein, 24 aa, Mus sp.
SPAPSTRVITNQYNSPTGLYSSEN

SEQ ID NO: 13158 - protein, 17 aa, Mus sp.
EWKFTITPPSAQVVGVL

SEQ ID NO: 13159 - protein, 15 aa, Mus sp.
WKFTITPPSAQVVGV

SEQ ID NO: 13160 - protein, 16 aa, Mus sp.
LLEAKGPVTDVAYSHD

SEQ ID NO: 13161 - protein, 16 aa, Mus sp.
LNVLRIINEPTAAAIA

SEQ ID NO: 13162 - protein, 22 aa, Mus sp.
LPNKPTVTVVSPLPNDSINPQP

SEQ ID NO: 13163 - protein, 11 aa, Mus sp.
IPFYTPIPNGL

SEQ ID NO: 13164 - protein, 17 aa, Mus sp.
LNVLRIINEPTAAAIAY

SEQ ID NO: 13165 - protein, 14 aa, Mus sp.
YTPYYVAPEVLGPE

SEQ ID NO: 13166 - protein, 14 aa, Mus sp.
YVTQFHPPHIEIQM

SEQ ID NO: 13167 - protein, 15 aa, Mus sp.
NVTELNEPLSNEERN

SEQ ID NO: 13168 - protein, 17 aa, Mus sp.
KEDRRYNPPIIHQGFQD

SEQ ID NO: 13169 - protein, 20 aa, Mus sp.
GNPLNSVFVAPAVTPVKGVL

SEQ ID NO: 13170 - protein, 16 aa, Mus sp.
KQIVWNGPVGVFEWEA

SEQ ID NO: 13171 - protein, 14 aa, Mus sp.
SVPATFAPSPTPAV

SEQ ID NO: 13172 - protein, 17 aa, Mus sp.
EAEEVYRNSMPASSFQQ

SEQ ID NO: 13173 - protein, 12 aa, Mus sp.
VPIVEPEILPDG

SEQ ID NO: 13174 - protein, 14 aa, Mus sp.
DGYQMAQPVFAPKN

SEQ ID NO: 13175 - protein, 14 aa, Mus sp.
IQFNNYQVRYRPEL

SEQ ID NO: 13176 - protein, 16 aa, Mus sp.
IPKTKFGKPDPIVSVI

SEQ ID NO: 13177 - protein, 19 aa, Mus sp.
AGEFDYSGSQAIKALKEEN

SEQ ID NO: 13178 - protein, 21 aa, Mus sp.
REPPPAYEPPAPAPAPLPPPS

SEQ ID NO: 13179 - protein, 16 aa, Mus sp.
TKKFRFEEPVVLPDLS

SEQ ID NO: 13180 - protein, 17 aa, Mus sp.
ITDKFWGPSGAESVIGG

SEQ ID NO: 13181 - protein, 18 aa, Mus sp.
DYPYPTDFLGPLPANPVK

SEQ ID NO: 13182 - protein, 15 aa, Mus sp.
FPQYTAPSILPSDIT

SEQ ID NO: 13183 - protein, 17 aa, Mus sp.
APAAATSAPAPAPAPAP

SEQ ID NO: 13184 - protein, 16 aa, Mus sp.
TLPPVSPPKAALSVDE

SEQ ID NO: 13185 - protein, 15 aa, Mus sp.
EDNVFEAPTLVKVFK

SEQ ID NO: 13186 - protein, 14 aa, Mus sp.
VIHFNNPKVQASLA

SEQ ID NO: 13187 - protein, 18 aa, Mus sp.
AQPPEYTFPSGSGAHFPQ

SEQ ID NO: 13188 - protein, 14 aa, Mus sp.
KNLDYVATSIHEAV

SEQ ID NO: 13189 - protein, 14 aa, Mus sp.
HTLFHNPHVNPLPT

SEQ ID NO: 13190 - protein, 16 aa, Mus sp.
KFDEWVAPTPEVADMQ

SEQ ID NO: 13191 - protein, 20 aa, Mus sp.
TPSSPSYSPSSPSYSPTSPK

SEQ ID NO: 13192 - protein, 17 aa, Mus sp.
DIDTAAKFIGAGAATVG

SEQ ID NO: 13193 - protein, 12 aa, Mus sp.
LYNQVKDLQEQN

SEQ ID NO: 13194 - protein, 18 aa, Mus sp.
GDLSQHATPLPTPAVLPG

SEQ ID NO: 13195 - protein, 22 aa, Mus sp.
IDVDPQEDPQNAPDVNYVVENP

SEQ ID NO: 13196 - protein, 22 aa, Mus sp.
AIEDDSGRETDSSSAPAVTPSK

SEQ ID NO: 13197 - protein, 12 aa, Mus sp.
YRGAQAAIVVYD

SEQ ID NO: 13198 - protein, 15 aa, Mus sp.
DFLKKWETPSQNTAQ

SEQ ID NO: 13199 - protein, 12 aa, Mus sp.
ALPYDTPVPGYM

SEQ ID NO: 13200 - protein, 16 aa, Mus sp.
SPTGNIFFSPFSISSA

SEQ ID NO: 13201 - protein, 20 aa, Mus sp.
DEGERYIAPTVLVDVQETEP

SEQ ID NO: 13202 - protein, 15 aa, Mus sp.
KNLDYVATSIHEAVT

SEQ ID NO: 13203 - protein, 16 aa, Mus sp.
LDKDSFSDPYAHVSFL

SEQ ID NO: 13204 - protein, 15 aa, Mus sp.
GGQVYAFPSSQSVTE

SEQ ID NO: 13205 - protein, 14 aa, Mus sp.
TNTAYVGSAILSEE

SEQ ID NO: 13206 - protein, 15 aa, Mus sp.
DPSAFAAAAPAAAAT

SEQ ID NO: 13207 - protein, 18 aa, Mus sp.
KPSPIYISSYSSPAREQN

SEQ ID NO: 13208 - protein, 15 aa, Mus sp.
STTEFEEPRVIDLWD

SEQ ID NO: 13209 - protein, 13 aa, Mus sp.
SDVIHAPLPSPVD

SEQ ID NO: 13210 - protein, 22 aa, Mus sp.
RRKGEQIYYAGPVNNPGLDVPQ

SEQ ID NO: 13211 - protein, 14 aa, Mus sp.
REVSSVEAPSVSPA

SEQ ID NO: 13212 - protein, 15 aa, Mus sp.
SKQEYDESGPSIVHR

SEQ ID NO: 13213 - protein, 17 aa, Mus sp.
SPYAFNGGTVLAIAGED

SEQ ID NO: 13214 - protein, 26 aa, Mus sp.
KVIPELNGKLTGMAFRVPTPNVSVVD

SEQ ID NO: 13215 - protein, 17 aa, Mus sp.
DTNLNDLGPRALEIYRA

SEQ ID NO: 13216 - protein, 19 aa, Mus sp.
VPDVDISSPGINVEAPDIH

SEQ ID NO: 13217 - protein, 14 aa, Mus sp.
GTPEYLAPEIILSK

SEQ ID NO: 13218 - protein, 14 aa, Mus sp.
IEVWERPLSNLAWA

SEQ ID NO: 13219 - protein, 19 aa, Mus sp.
APGRDLHYQNPHSNAVGNP

SEQ ID NO: 13220 - protein, 8 aa, Mus sp.
FNLVYENL

SEQ ID NO: 13221 - protein, 19 aa, Mus sp.
KKFGNSEFDPPGPNVATTT

SEQ ID NO: 13222 - protein, 16 aa, Mus sp.
ESKEAFQEALAAAGDK

SEQ ID NO: 13223 - protein, 12 aa, Mus sp.
FPYVTPAPHEPV

SEQ ID NO: 13224 - protein, 16 aa, Mus sp.
FPIKWTAPEAALYGRF

SEQ ID NO: 13225 - protein, 17 aa, Mus sp.
TDINAFVGAVSLTAADS

SEQ ID NO: 13226 - protein, 16 aa, Mus sp.
FNPGDASGPEAAGSPP

SEQ ID NO: 13227 - protein, 20 aa, Mus sp.
FAAEEFKVPAATSAIITNDG

SEQ ID NO: 13228 - protein, 18 aa, Mus sp.
DDGTVIHFNNPKVQASLS

SEQ ID NO: 13229 - protein, 14 aa, Mus sp.
YALVYTSPVIPELK

SEQ ID NO: 13230 - protein, 17 aa, Mus sp.
KEVLDYSTPTTNGTPEA

SEQ ID NO: 13231 - protein, 13 aa, Mus sp.
DTIEFRGPNGLLV

SEQ ID NO: 13232 - protein, 18 aa, Mus sp.
AGPNFEYAEAPSRLSPDD

SEQ ID NO: 13233 - protein, 18 aa, Mus sp.
VPVPEFADSDPANIVHDF

SEQ ID NO: 13234 - protein, 16 aa, Mus sp.
FPGAQHYVGGNAALIG

SEQ ID NO: 13235 - protein, 20 aa, Mus sp.
QLQPQPATLLGKAGAFPPPA

SEQ ID NO: 13236 - protein, 17 aa, Mus sp.
APAPAAAPAAAPAAAPE

SEQ ID NO: 13237 - protein, 15 aa, Mus sp.
TPDYISPEILQAMED

SEQ ID NO: 13238 - protein, 14 aa, Mus sp.
RTWNDPSVQQDIKF

SEQ ID NO: 13239 - protein, 11 aa, Mus sp.
VPWSPPQSNWN

SEQ ID NO: 13240 - protein, 18 aa, Mus sp.
GPVPEFSGATVERVSEDM

SEQ ID NO: 13241 - protein, 14 aa, Mus sp.
INYQPPTVVPGGDL

SEQ ID NO: 13242 - protein, 16 aa, Mus sp.
FKKPSWLTPVPESHKL

SEQ ID NO: 13243 - protein, 13 aa, Mus sp.
IKVYWDAPSPAPD

SEQ ID NO: 13244 - protein, 12 aa, Mus sp.
KLQMEAPHIIVG

SEQ ID NO: 13245 - protein, 8 aa, Mus sp.
AVYTFETL

SEQ ID NO: 13246 - protein, 14 aa, Mus sp.
SSPYNPPDLEEAAK

SEQ ID NO: 13247 - protein, 15 aa, Mus sp.
AFDTRAPMAAQGMVE

SEQ ID NO: 13248 - protein, 19 aa, Mus sp.
KAHAFSVEALIGAEKQQQL

SEQ ID NO: 13249 - protein, 22 aa, Listeria monocytogenes
APGAELIYGHKAASREEFATWA

SEQ ID NO: 13250 - protein, 22 aa, Mus sp.
GADELLKRVYGSFLVNPEPGYN

SEQ ID NO: 13251 - protein, 17 aa, Mus sp.
GRERYNFPNPNPFVEDD

SEQ ID NO: 13252 - protein, 11 aa, Mus sp.
RYMAPEVLDET

SEQ ID NO: 13253 - protein, 16 aa, Mus sp.
ESKIRYKTSEPVWEEN

SEQ ID NO: 13254 - protein, 16 aa, Mus sp.
GEEDWTISPVPQSIVD

SEQ ID NO: 13255 - protein, 13 aa, Mus sp.
QEVLAPQVVLSLG

SEQ ID NO: 13256 - protein, 16 aa, Mus sp.
AKVELVPPTPAEIPTA

SEQ ID NO: 13257 - protein, 16 aa, Mus sp.
IPQAERYQEALPTVAN

SEQ ID NO: 13258 - protein, 9 aa, Mus sp.
LIMVMMEDY

SEQ ID NO: 13259 - protein, 15 aa, Mus sp.
LEVVTDPTTNAGYVK

SEQ ID NO: 13260 - protein, 17 aa, Mus sp.
GDGRNYLLAFQKGIRNK

SEQ ID NO: 13261 - protein, 16 aa, Mus sp.
GAQEMVSSSVSSAKET

SEQ ID NO: 13262 - protein, 18 aa, Mus sp.
KLLEAKGPVTDVAYSHDG

SEQ ID NO: 13263 - protein, 16 aa, Mus sp.
LSLDWHPNNVLLAAGS

SEQ ID NO: 13264 - protein, 14 aa, Mus sp.
GKKFTAPHILIATG

SEQ ID NO: 13265 - protein, 16 aa, Mus sp.
NDLQYAAPGGLIGVGT

SEQ ID NO: 13266 - protein, 13 aa, Mus sp.
EQIYYAGPVNNPG

SEQ ID NO: 13267 - protein, 14 aa, Mus sp.
QDAYHFFSPEPLNS

SEQ ID NO: 13268 - protein, 18 aa, Mus sp.
IEVDQIYHLASPASPPNY

SEQ ID NO: 13269 - protein, 16 aa, Mus sp.
SGVEWKGPQVSSSLNL

SEQ ID NO: 13270 - protein, 16 aa, Mus sp.
GDGIEDFVSGVPRAAR

SEQ ID NO: 13271 - protein, 19 aa, Mus sp.
RAKQIVWNGPVGVFEWEAF

SEQ ID NO: 13272 - protein, 15 aa, Mus sp.
THDLYIQSHISENRE

SEQ ID NO: 13273 - protein, 17 aa, Mus sp.
TQSSCYISQLMFFMKSP

SEQ ID NO: 13274 - protein, 19 aa, Mus sp.
DLYTAKGLFRAAVPSGAST

SEQ ID NO: 13275 - protein, 15 aa, Mus sp.
LPTTFQGATASTSYG

SEQ ID NO: 13276 - protein, 17 aa, Mus sp.
LAVLEQEPIVLPAWDPM

SEQ ID NO: 13277 - protein, 14 aa, Mus sp.
LDNYDAPDIANIAI

SEQ ID NO: 13278 - protein, 14 aa, Mus sp.
YPNSFSAPEQQRSA

SEQ ID NO: 13279 - protein, 15 aa, Mus sp.
FPDNYNSPTPYKIQY

SEQ ID NO: 13280 - protein, 17 aa, Mus sp.
HGSLFLKTPKIVSSKDY

SEQ ID NO: 13281 - protein, 15 aa, Mus sp.
ARDNMFSGSKINYTE

SEQ ID NO: 13282 - protein, 16 aa, Mus sp.
DVPEWFRGSRLNYAEN

SEQ ID NO: 13283 - protein, 16 aa, Mus sp.
KNVTELNEPLSNEERN

SEQ ID NO: 13284 - protein, 15 aa, Mus sp.
LVEALEQPAPAIVSA

SEQ ID NO: 13285 - protein, 18 aa, Mus sp.
DGNHTLFHNPHVNPLPTG

SEQ ID NO: 13286 - protein, 14 aa, Mus sp.
KIVYEGPELNHAFG

SEQ ID NO: 13287 - protein, 12 aa, Mus sp.
EEYSAPLPTPAP

SEQ ID NO: 13288 - protein, 15 aa, Mus sp.
IKIAWESPQGQVSRY

SEQ ID NO: 13289 - protein, 16 aa, Mus sp.
NPLNSVFVAPAVTPVK

SEQ ID NO: 13290 - protein, 16 aa, Mus sp.
SGLEVVAPEVTSAPVS

SEQ ID NO: 13291 - protein, 14 aa, Mus sp.
DIFIGPKAEEHRGL

SEQ ID NO: 13292 - protein, 13 aa, Mus sp.
ELWDSPEPASAPR

SEQ ID NO: 13293 - protein, 17 aa, Mus sp.
GDTHFDSAEPWTVQNED

SEQ ID NO: 13294 - protein, 17 aa, Mus sp.
KSFVQNYPVVSIEDPFD

SEQ ID NO: 13295 - protein, 27 aa, Mus sp.
SNDTTVLLPPYDDATAVPSTAKEPPPP

SEQ ID NO: 13296 - protein, 12 aa, Mus sp.
FRVPTPNVSVVD

SEQ ID NO: 13297 - protein, 17 aa, Mus sp.
APINAFIGGLAAQEVMK

SEQ ID NO: 13298 - protein, 13 aa, Mus sp.
EVAFNGPKGGYVA

SEQ ID NO: 13299 - protein, 14 aa, Mus sp.
VRVDEYDYSKPIQG

SEQ ID NO: 13300 - protein, 15 aa, Mus sp.
FRLWDFRDPSIHSVN

SEQ ID NO: 13301 - protein, 13 aa, Mus sp.
GTSYQSPHGIPID

SEQ ID NO: 13302 - protein, 19 aa, Mus sp.
ITRDLKWGTPVPLEGFEDK

SEQ ID NO: 13303 - protein, 16 aa, Mus sp.
LQFGYNTGVINAPQKV

SEQ ID NO: 13304 - protein, 14 aa, Mus sp.
GDLEYQMSTTARAK

SEQ ID NO: 13305 - protein, 19 aa, Mus sp.
LPPHVYSTPQPSLPPVQPS

SEQ ID NO: 13306 - protein, 17 aa, Mus sp.
GDVVHGFYNPAVSRIVE

SEQ ID NO: 13307 - protein, 18 aa, Mus sp.
NRITPSYVAFTPEGERLI

SEQ ID NO: 13308 - protein, 15 aa, Mus sp.
VTDYYTLPIGIRTVA

SEQ ID NO: 13309 - protein, 14 aa, Mus sp.
DTEVYESPYADPEE

SEQ ID NO: 13310 - protein, 19 aa, Mus sp.
SPSSPEYTPASPKYSPTSP

SEQ ID NO: 13311 - protein, 17 aa, Mus sp.
GPRPEEYEFLTPVEEAP

SEQ ID NO: 13312 - protein, 13 aa, Mus sp.
SALEYGMPVTLIG

SEQ ID NO: 13313 - protein, 17 aa, Mus sp.
VGTIRYMAPEVLEGAVN

SEQ ID NO: 13314 - protein, 14 aa, Mus sp.
NLRDNYRFAHTNIE

SEQ ID NO: 13315 - protein, 16 aa, Mus sp.
VPNDKWFGSGALLSES

SEQ ID NO: 13316 - protein, 14 aa, Mus sp.
QKAMFDHLSYLLEN

SEQ ID NO: 13317 - protein, 14 aa, Mus sp.
GGDPFAAPQVVPAF

SEQ ID NO: 13318 - protein, 16 aa, Mus sp.
LIGRTWNDPSVQQDIK

SEQ ID NO: 13319 - protein, 24 aa, Mus sp.
TSPDWAGDMTQGHRSQEELSGPES

SEQ ID NO: 13320 - protein, 17 aa, Mus sp.
ENLYPYLGPSTLRDRPQ

SEQ ID NO: 13321 - protein, 16 aa, Mus sp.
VYIPTYTKPNPNQIIS

SEQ ID NO: 13322 - protein, 13 aa, Mus sp.
YKPFQNPVPNQSP

SEQ ID NO: 13323 - protein, 14 aa, Mus sp.
DVYKYETSGIGEAR

SEQ ID NO: 13324 - protein, 14 aa, Mus sp.
YIEGYVPSQADVAV

SEQ ID NO: 13325 - protein, 13 aa, Mus sp.
YEWAPPVQNQALA

SEQ ID NO: 13326 - protein, 12 aa, Mus sp.
LDYYDSPSVNAR

SEQ ID NO: 13327 - protein, 13 aa, Mus sp.
EWKDYKAGFGNLE

SEQ ID NO: 13328 - protein, 14 aa, Mus sp.
IFYGASIASLSASH

SEQ ID NO: 13329 - protein, 17 aa, Mus sp.
ESKEAFQEALAAAGDKL

SEQ ID NO: 13330 - protein, 12 aa, Mus sp.
VTQFHPPHIEIQ

SEQ ID NO: 13331 - protein, 17 aa, Mus sp.
KPGTTVEYLAPWANQID

SEQ ID NO: 13332 - protein, 19 aa, Mus sp.
IPSPSSAFTPAHAATSSHA

SEQ ID NO: 13333 - protein, 15 aa, Mus sp.
DPKLTYHGFTLEDAA

SEQ ID NO: 13334 - protein, 13 aa, Mus sp.
EQIAVVAPEPLLT

SEQ ID NO: 13335 - protein, 15 aa, Mus sp.
VLIPYQGPSSDYVVV

SEQ ID NO: 13336 - protein, 20 aa, Mus sp.
TPSPESPDQWSSSSPHSASD

SEQ ID NO: 13337 - protein, 19 aa, Mus sp.
KLTGMAFRVPTPNVSVVDL

SEQ ID NO: 13338 - protein, 18 aa, BOVIN
GPPVASVVVGPSVVAVPL

SEQ ID NO: 13339 - protein, 17 aa, Mus sp.
ASAYYNPGNPHNVYMPT

SEQ ID NO: 13340 - protein, 17 aa, Mus sp.
DTIEFRGPNGLLVYQGK

SEQ ID NO: 13341 - protein, 16 aa, Mus sp.
SPVDFHTPSSPKSPPS

SEQ ID NO: 13342 - protein, 16 aa, Mus sp.
SNPSYNYEIVNRASLA

SEQ ID NO: 13343 - protein, 16 aa, Mus sp.
LDAYPVENQGLKLGFN

SEQ ID NO: 13344 - protein, 13 aa, Mus sp.
NNPWVTPIADQFQ

SEQ ID NO: 13345 - protein, 14 aa, Mus sp.
LSLKYHFVTPLTSM

SEQ ID NO: 13346 - protein, 18 aa, Mus sp.
KPDSLMGAPSAMVSFYPD

SEQ ID NO: 13347 - protein, 19 aa, Mus sp.
EGNMHYDTPDIRRFDPVPA

SEQ ID NO: 13348 - protein, 15 aa, Mus sp.
KFIYVDVLPEEAVGP

SEQ ID NO: 13349 - protein, 15 aa, Mus sp.
AVKSKYKASIAALEA

SEQ ID NO: 13350 - protein, 16 aa, Mus sp.
VRVDEYDYSKPIQGQQ

SEQ ID NO: 13351 - protein, 12 aa, Mus sp.
YYRGAQAAIVVY

SEQ ID NO: 13352 - protein, 16 aa, Mus sp.
SIVYWMTSQPSDAVRF

SEQ ID NO: 13353 - protein, 18 aa, Mus sp.
IKPGTTVEYLAPWANQID

SEQ ID NO: 13354 - protein, 8 aa, Mus sp.
INFDFPKL

SEQ ID NO: 13355 - protein, 15 aa, Mus sp.
DLKWGTPVPLEGFED

SEQ ID NO: 13356 - protein, 14 aa, Mus sp.
FTITPPSAQVVGVL

SEQ ID NO: 13357 - protein, 18 aa, Mus sp.
VADKEFHAPLIIDENGVH

SEQ ID NO: 13358 - protein, 14 aa, Mus sp.
NPDFTQPISEVVDE

SEQ ID NO: 13359 - protein, 18 aa, Mus sp.
TRELWDSPEPASAPRTPQ

SEQ ID NO: 13360 - protein, 15 aa, Mus sp.
KPEDYQGGRTGEAIV

SEQ ID NO: 13361 - protein, 16 aa, Mus sp.
GVDFIGSTVGLAKVSA

SEQ ID NO: 13362 - protein, 13 aa, BOVIN
SVVVGPSVVAVPL

SEQ ID NO: 13363 - protein, 19 aa, Mus sp.
DPAVIKSLTIQPDPIVVPG

SEQ ID NO: 13364 - protein, 20 aa, Mus sp.
APSEERVYMVGKANSVFEDL

SEQ ID NO: 13365 - protein, 18 aa, Mus sp.
NNAYYLDKMHYSIEGKDT

SEQ ID NO: 13366 - protein, 15 aa, Mus sp.
IGVGAYVSPDMMVAE

SEQ ID NO: 13367 - protein, 18 aa, Mus sp.
DLPNSFDGPVTITIVNRD

SEQ ID NO: 13368 - protein, 11 aa, Mus sp.
AWTGPMGNWAM

SEQ ID NO: 13369 - protein, 14 aa, Mus sp.
RTWAWEAVEALESH

SEQ ID NO: 13370 - protein, 16 aa, Mus sp.
GTKRYMAPEVLDETIN

SEQ ID NO: 13371 - protein, 14 aa, Mus sp.
RSYSSPDITQALQE

SEQ ID NO: 13372 - protein, 15 aa, Mus sp.
SKEFEFIESQTSSHR

SEQ ID NO: 13373 - protein, 19 aa, Mus sp.
APAAAATTAAPAAAAAPAK

SEQ ID NO: 13374 - protein, 18 aa, Mus sp.
GYAVYETPTAHNGAKNPR

SEQ ID NO: 13375 - protein, 12 aa, Mus sp.
NSYPVYLMEQQN

SEQ ID NO: 13376 - protein, 16 aa, Mus sp.
DGQSVQWWHPQGIIGL

SEQ ID NO: 13377 - protein, 16 aa, Mus sp.
TEDDYNEPTVHFAEDT

SEQ ID NO: 13378 - protein, 15 aa, Mus sp.
EDYVELPPSVSQAAT

SEQ ID NO: 13379 - protein, 17 aa, Mus sp.
TTSSYSNPTIGYENRVL

SEQ ID NO: 13380 - protein, 16 aa, Mus sp.
VSTLIWAAPRLQSEVA

SEQ ID NO: 13381 - protein, 17 aa, BOVIN
YQEPVLGPVRGPFPIIV

SEQ ID NO: 13382 - protein, 18 aa, Mus sp.
QPSTSSLAAPTVEAAASA

SEQ ID NO: 13383 - protein, 16 aa, Mus sp.
GSVTYIAPPGNYDASD

SEQ ID NO: 13384 - protein, 17 aa, Mus sp.
APAPEFTAAQPEVADWS

SEQ ID NO: 13385 - protein, 16 aa, Mus sp.
TKNLDYVATSIHEAVT

SEQ ID NO: 13386 - protein, 20 aa, Mus sp.
KKVIEDRDHYIPNTLNPVFG

SEQ ID NO: 13387 - protein, 15 aa, Mus sp.
GPKPFSAPKPQTSPS

SEQ ID NO: 13388 - protein, 17 aa, Mus sp.
KWKALYTDPKSSETAAF

SEQ ID NO: 13389 - protein, 18 aa, Mus sp.
SLKYHFVTPLTSMVVTKP

SEQ ID NO: 13390 - protein, 24 aa, Mus sp.
KPTVTVVSPLPNDSINPQPSPDGL

SEQ ID NO: 13391 - protein, 17 aa, Mus sp.
GPKPFSAPKPQTSPSPK

SEQ ID NO: 13392 - protein, 17 aa, Mus sp.
YTPYYVAPEVLGPEKYD

SEQ ID NO: 13393 - protein, 15 aa, Mus sp.
DRKIVYEGPELNHAF

SEQ ID NO: 13394 - protein, 15 aa, Mus sp.
SELLRSAQPASAEPR

SEQ ID NO: 13395 - protein, 25 aa, Mus sp.
GPGEPSPVSETVVTPEAAPEKNPVD

SEQ ID NO: 13396 - protein, 15 aa, Mus sp.
APMYYRGAQAAIVVY

SEQ ID NO: 13397 - protein, 17 aa, Mus sp.
TVPFWAHAGNAIPSADQ

SEQ ID NO: 13398 - protein, 17 aa, Mus sp.
ASLEDFYGSPIPSVSLK

SEQ ID NO: 13399 - protein, 15 aa, Mus sp.
GERFEAPEALFQPHL

SEQ ID NO: 13400 - protein, 13 aa, Mus sp.
ETTIWVSPSPILE

SEQ ID NO: 13401 - protein, 15 aa, Mus sp.
TIRYMAPEVLEGAVN

SEQ ID NO: 13402 - protein, 18 aa, Mus sp.
DSSRLPSEGPQPAHVVVG

SEQ ID NO: 13403 - protein, 18 aa, Mus sp.
APDAWDYSQGFVNEEMIR

SEQ ID NO: 13404 - protein, 15 aa, Mus sp.
NSEFDPPGPNVATTT

SEQ ID NO: 13405 - protein, 15 aa, Mus sp.
HPIQWNAPEPSHITK

SEQ ID NO: 13406 - protein, 17 aa, Mus sp.
VPPTPQPVAPTPSAAPA

SEQ ID NO: 13407 - protein, 16 aa, Mus sp.
GTIRYMAPEVLEGAVN

SEQ ID NO: 13408 - protein, 18 aa, Mus sp.
DGTVIHFNNPKVQASLSA

SEQ ID NO: 13409 - protein, 18 aa, Mus sp.
GPGSAVSPYPSFNVSSDV

SEQ ID NO: 13410 - protein, 14 aa, Mus sp.
LPDYSAPNPIKVTH

SEQ ID NO: 13411 - protein, 18 aa, Mus sp.
TDKFWGPSGAESVIGGVH

SEQ ID NO: 13412 - protein, 17 aa, Mus sp.
HKLSYLTFIPSDDDIYD

SEQ ID NO: 13413 - protein, 14 aa, Mus sp.
FIVKYELPLVIKAL

SEQ ID NO: 13414 - protein, 15 aa, Mus sp.
LEALVGPEANVGPYG

SEQ ID NO: 13415 - protein, 14 aa, Mus sp.
EALVGPEANVGPYG

SEQ ID NO: 13416 - protein, 18 aa, Mus sp.
FPPEFYEHAKALWEDEGV

SEQ ID NO: 13417 - protein, 14 aa, Mus sp.
VGGERFEAPEALFQ

SEQ ID NO: 13418 - protein, 11 aa, Mus sp.
TPWKAPIVWEG

SEQ ID NO: 13419 - protein, 16 aa, Mus sp.
VVDNVSSPETIVVFNG

SEQ ID NO: 13420 - protein, 14 aa, Mus sp.
EVWERPLSNLAWAV

SEQ ID NO: 13421 - protein, 18 aa, Mus sp.
NSNSYGIPEPAHAYAQPQ

SEQ ID NO: 13422 - protein, 17 aa, Mus sp.
GKKFTAPHILIATGGVP

SEQ ID NO: 13423 - protein, 15 aa, Mus sp.
LVKDGYQMAQPVFAP

SEQ ID NO: 13424 - protein, 15 aa, Mus sp.
SLKYHFVTPLTSMVV

SEQ ID NO: 13425 - protein, 17 aa, Mus sp.
PLKEDNWSLPNRAVEPQ

SEQ ID NO: 13426 - protein, 17 aa, Mus sp.
GEVKAFFESHPAPSAER

SEQ ID NO: 13427 - protein, 15 aa, BOVIN
AVPDAAGPTPSAAGP

SEQ ID NO: 13428 - protein, 13 aa, Mus sp.
LVEYEASAAGLIR

SEQ ID NO: 13429 - protein, 17 aa, Mus sp.
SGALLLNAPVVSITQGR

SEQ ID NO: 13430 - protein, 15 aa, Mus sp.
LKYHFVTPLTSMVVT

SEQ ID NO: 13431 - protein, 14 aa, Mus sp.
GDDWTIFQSNHSTY

SEQ ID NO: 13432 - protein, 10 aa, Mus sp.
TPDYIAPEII

SEQ ID NO: 13433 - protein, 19 aa, Mus sp.
GPDGRFVMGPTVAPSQEKL

SEQ ID NO: 13434 - protein, 14 aa, Mus sp.
LVHIFKPDVSPNFG

SEQ ID NO: 13435 - protein, 16 aa, Mus sp.
YAKVELVPPTPAEIPT

SEQ ID NO: 13436 - protein, 27 aa, Mus sp.
FPGPNIGGDTHFDSAEPWTVQNEDLNG

SEQ ID NO: 13437 - protein, 24 aa, Mus sp.
KPFPWGDGNHTLFHNPHVNPLPTG

SEQ ID NO: 13438 - protein, 16 aa, Mus sp.
GEPYMYLSPLQQAVSD

SEQ ID NO: 13439 - protein, 20 aa, Mus sp.
DPEDHTVSFVQPNGAIFEPS

SEQ ID NO: 13440 - protein, 25 aa, Mus sp.
LPDGRIIKVGGERFEAPEALFQPHL

SEQ ID NO: 13441 - protein, 15 aa, Mus sp.
LSYREPDPEDAVGGS

SEQ ID NO: 13442 - protein, 17 aa, Mus sp.
VGTKRYMAPEVLDDSIN

SEQ ID NO: 13443 - protein, 15 aa, Mus sp.
EVEHWFYPQENIIDT

SEQ ID NO: 13444 - protein, 13 aa, Mus sp.
ALPYDTPVPGYMN

SEQ ID NO: 13445 - protein, 14 aa, Mus sp.
GVAYEAPSLATGYG

SEQ ID NO: 13446 - protein, 15 aa, Mus sp.
VGINYQPPTVVPGGD

SEQ ID NO: 13447 - protein, 25 aa, Mus sp.
DPTPDPNTAYASYPSASVENYQQPP

SEQ ID NO: 13448 - protein, 15 aa, Mus sp.
DNYLTSPLPEEVDET

SEQ ID NO: 13449 - protein, 19 aa, Mus sp.
YNIPFTEKNILYSAFLWRT

SEQ ID NO: 13450 - protein, 17 aa, Mus sp.
GIDPYDQPNAIYIERHE

SEQ ID NO: 13451 - protein, 18 aa, Mus sp.
GPAGPGAVEGPNPASSPD

SEQ ID NO: 13452 - protein, 13 aa, Mus sp.
VQPYSGSPANLAA

SEQ ID NO: 13453 - protein, 21 aa, Mus sp.
DPETSVLILRKPGVSVASDWS

SEQ ID NO: 13454 - protein, 16 aa, Mus sp.
SPVSETVVTPEAAPEK

SEQ ID NO: 13455 - protein, 14 aa, Mus sp.
LALPYDTPVPGYMN

SEQ ID NO: 13456 - protein, 17 aa, Mus sp.
ITSSYYRGAHGIIVVYD

SEQ ID NO: 13457 - protein, 18 aa, Mus sp.
DPSKTGIGAPTISTGPPG

SEQ ID NO: 13458 - protein, 21 aa, Mus sp.
VLITDKFWGPSGAESVIGGVH

SEQ ID NO: 13459 - protein, 15 aa, Mus sp.
IDIFSTPSSSNSTSK

SEQ ID NO: 13460 - protein, 22 aa, Listeria monocytogenes
RDNYLFQLYEATGTPIHPMSPF

SEQ ID NO: 13461 - protein, 15 aa, Mus sp.
LPPHVYSTPQPSLPP

SEQ ID NO: 13462 - protein, 16 aa, Mus sp.
ISALFVTPKTAGAQVV

SEQ ID NO: 13463 - protein, 15 aa, Mus sp.
GGVYASPSIAGSRPG

SEQ ID NO: 13464 - protein, 15 aa, Mus sp.
ALVVTTPQAVSIGDV

SEQ ID NO: 13465 - protein, 16 aa, Mus sp.
DPTTAFQAPDVGQALL

SEQ ID NO: 13466 - protein, 13 aa, Mus sp.
SLKYHFVTPLTSM

SEQ ID NO: 13467 - protein, 15 aa, Mus sp.
LDYWTYPGSLTTPPL

SEQ ID NO: 13468 - protein, 15 aa, Mus sp.
YPTAYPAAAPAYNPS

SEQ ID NO: 13469 - protein, 15 aa, Mus sp.
SNLSYREPDPEDAVG

SEQ ID NO: 13470 - protein, 14 aa, Mus sp.
EVSSVEAPSVSPAR

SEQ ID NO: 13471 - protein, 18 aa, Mus sp.
MKNVTELNEPLSNEERNL

SEQ ID NO: 13472 - protein, 24 aa, Mus sp.
LDSLIGDSNFGAPSASVAAAPAPA

SEQ ID NO: 13473 - protein, 16 aa, Mus sp.
VLFVYGGPQVQLVNNS

SEQ ID NO: 13474 - protein, 14 aa, Mus sp.
WTFSTTGALESAVA

SEQ ID NO: 13475 - protein, 14 aa, Mus sp.
VLLPFFDPDTNIVY

SEQ ID NO: 13476 - protein, 16 aa, Mus sp.
LGEFDTPEAIWSSEMR

SEQ ID NO: 13477 - protein, 15 aa, Mus sp.
EELYMPPLVIKVIDH

SEQ ID NO: 13478 - protein, 13 aa, Mus sp.
GTPEYLAPEIILS

SEQ ID NO: 13479 - protein, 15 aa, Mus sp.
VIHFNNPKVQASLAA

SEQ ID NO: 13480 - protein, 17 aa, Mus sp.
IPETYPFNPPKVRFITK

SEQ ID NO: 13481 - protein, 15 aa, Mus sp.
GYDPIISPEVAASFG

SEQ ID NO: 13482 - protein, 15 aa, Mus sp.
VGGERFEAPEALFQP

SEQ ID NO: 13483 - protein, 18 aa, Mus sp.
APISSHTAPRPNPTPALP

SEQ ID NO: 13484 - protein, 16 aa, Mus sp.
KKVIYSQPSTRSEGEF

SEQ ID NO: 13485 - protein, 20 aa, Mus sp.
SDDVLANMISEPRISYGNDA

SEQ ID NO: 13486 - protein, 16 aa, Mus sp.
APKETTIWVSPSPILE

SEQ ID NO: 13487 - protein, 17 aa, Mus sp.
NHIEVWERPLSNLAWAV

SEQ ID NO: 13488 - protein, 15 aa, Mus sp.
TAQWNICLPLLQHNL

SEQ ID NO: 13489 - protein, 19 aa, Mus sp.
GELTYENVQVSPVPGGPPG

SEQ ID NO: 13490 - protein, 15 aa, Mus sp.
VPPPFAAAAINEAID

SEQ ID NO: 13491 - protein, 19 aa, Mus sp.
VDSPDVVYSPETIEARYEY

SEQ ID NO: 13492 - protein, 13 aa, Mus sp.
IDIFARPTAGFIT

SEQ ID NO: 13493 - protein, 13 aa, Mus sp.
FPYEGPAPLEAIA

SEQ ID NO: 13494 - protein, 17 aa, Mus sp.
GTVDVVLTPLVAEALDR

SEQ ID NO: 13495 - protein, 17 aa, Mus sp.
DTKVVFLSPAVPEEPEA

SEQ ID NO: 13496 - protein, 19 aa, Mus sp.
MEKEDRRYNPPIIHQGFQD

SEQ ID NO: 13497 - protein, 16 aa, Mus sp.
ARDNMFSGSKINYTEN

SEQ ID NO: 13498 - protein, 10 aa, Mus sp.
IPFYTPIPNG

SEQ ID NO: 13499 - protein, 18 aa, Mus sp.
MEKEDRRYNPPIIHQGFQ

SEQ ID NO: 13500 - protein, 18 aa, Mus sp.
IDFEDVIAEPEGTHSFDG

SEQ ID NO: 13501 - protein, 16 aa, Mus sp.
KAVDVFFPPEAQNDFP

SEQ ID NO: 13502 - protein, 15 aa, Mus sp.
NPDFTQPISEVVDEV

SEQ ID NO: 13503 - protein, 21 aa, Mus sp.
AFLGGGAPGSRHPGGGDYEEL

SEQ ID NO: 13504 - protein, 14 aa, Mus sp.
DGFSWPATLPSVYK

SEQ ID NO: 13505 - protein, 21 aa, Mus sp.
EGDTYEYRVSAVNIVGQGKPS

SEQ ID NO: 13506 - protein, 16 aa, Mus sp.
AGGDARNKKLPNGPAF

SEQ ID NO: 13507 - protein, 12 aa, Mus sp.
TNPIITPVAQEN

SEQ ID NO: 13508 - protein, 14 aa, Mus sp.
MRYFETAVSRPGLE

SEQ ID NO: 13509 - protein, 15 aa, Mus sp.
GDLEYQMSTTARAKR

SEQ ID NO: 13510 - protein, 13 aa, Mus sp.
DQLEWQSNQPWEQ

SEQ ID NO: 13511 - protein, 15 aa, Mus sp.
LNLAYIGAVPHSGIE

SEQ ID NO: 13512 - protein, 13 aa, Mus sp.
TAYASYPSASVEN

SEQ ID NO: 13513 - protein, 17 aa, Mus sp.
ITGVDFIGSTVGLAKVS

SEQ ID NO: 13514 - protein, 16 aa, Mus sp.
ADPSAFAAAAPAAAAT

SEQ ID NO: 13515 - protein, 21 aa, Mus sp.
GPPRLDLLDLAPEPRYAHIPV

SEQ ID NO: 13516 - protein, 14 aa, Mus sp.
IEGYVPSQADVAVF

SEQ ID NO: 13517 - protein, 16 aa, Mus sp.
NSEVYHEPHIADAWPQ

SEQ ID NO: 13518 - protein, 12 aa, Mus sp.
KIVYEGPELNHA

SEQ ID NO: 13519 - protein, 17 aa, Mus sp.
KYQNVSGFSNVNINRHS

SEQ ID NO: 13520 - protein, 13 aa, Mus sp.
GGHKLGLALELEA

SEQ ID NO: 13521 - protein, 18 aa, Mus sp.
LEDPDGFSWPATLPSVYK

SEQ ID NO: 13522 - protein, 14 aa, Mus sp.
EFDYSGSQAIKALK

SEQ ID NO: 13523 - protein, 17 aa, Mus sp.
ISLPHFLHASPDVSEPI

SEQ ID NO: 13524 - protein, 14 aa, Mus sp.
LPYKSPGINVDSSY

SEQ ID NO: 13525 - protein, 16 aa, Mus sp.
KTPEIVAPESAHAAFD

SEQ ID NO: 13526 - protein, 13 aa, Mus sp.
RYMAPEVLEGAIN

SEQ ID NO: 13527 - protein, 29 aa, Mus sp.
KKVNRITGLDPAGPNFEYAEAPSRLSPDD

SEQ ID NO: 13528 - protein, 14 aa, Mus sp.
FGPYYTEPVIAGLD

SEQ ID NO: 13529 - protein, 16 aa, Mus sp.
RPYLNWNGPPASLEEA

SEQ ID NO: 13530 - protein, 17 aa, Mus sp.
TSSLAAPTVEAAASAPA

SEQ ID NO: 13531 - protein, 17 aa, Mus sp.
TPRVLSQAPSPLYSVEF

SEQ ID NO: 13532 - protein, 14 aa, Mus sp.
TSSYYRGAHGIIVV

SEQ ID NO: 13533 - protein, 15 aa, Mus sp.
KWKALYTDPKSSETA

SEQ ID NO: 13534 - protein, 16 aa, Mus sp.
TPTFTYKAAHIFFTDT

SEQ ID NO: 13535 - protein, 14 aa, Mus sp.
GFPYEGPAPLEAIA

SEQ ID NO: 13536 - protein, 17 aa, Mus sp.
LPRSQYDYVLPQVSFTA

SEQ ID NO: 13537 - protein, 18 aa, Mus sp.
VLITDKFWGPSGAESVIG

SEQ ID NO: 13538 - protein, 15 aa, Mus sp.
VEALEQPAPAIVSAL

SEQ ID NO: 13539 - protein, 15 aa, Mus sp.
TPWKAPIVWEGTYDT

SEQ ID NO: 13540 - protein, 17 aa, Mus sp.
TPRDYYFALAHTVRDHL

SEQ ID NO: 13541 - protein, 15 aa, Mus sp.
TGMAFRVPTPNVSVV

SEQ ID NO: 13542 - protein, 16 aa, Mus sp.
EKPVPAAPVPSPVAPA

SEQ ID NO: 13543 - protein, 12 aa, Mus sp.
IVYWMTSQPSDA

SEQ ID NO: 13544 - protein, 16 aa, Mus sp.
SKEAFQEALAAAGDKL

SEQ ID NO: 13545 - protein, 20 aa, Mus sp.
NNLGLFINHYPNGVVTVNCA

SEQ ID NO: 13546 - protein, 16 aa, Mus sp.
MGRERYNFPNPNPFVE

SEQ ID NO: 13547 - protein, 17 aa, Mus sp.
GLDSQGCFCAGCSRQIG

SEQ ID NO: 13548 - protein, 15 aa, Mus sp.
AAVAWEAGKPLSIEE

SEQ ID NO: 13549 - protein, 17 aa, Mus sp.
APMYYRGAQAAIVVYDI

SEQ ID NO: 13550 - protein, 16 aa, Mus sp.
VELPPSVSQAATSPPG

SEQ ID NO: 13551 - protein, 31 aa, Listeria monocytogenes; identical to SEQ ID NO: 420

SEQ ID NO: 13552 - protein, 24 aa, Mus sp.
EETELDQLFSGPLPGRLPVNHRPF

SEQ ID NO: 13553 - protein, 19 aa, Mus sp.
YKKELEEQLGPVAEETRAR

SEQ ID NO: 13554 - protein, 18 aa, Mus sp.
APAPEFTAAQPEVADWSE

SEQ ID NO: 13555 - protein, 19 aa, Mus sp.
GVEAARDNMFSGSKINYTE

SEQ ID NO: 13556 - protein, 13 aa, Mus sp.
LDNYDAPDIANIA

SEQ ID NO: 13557 - protein, 13 aa, Mus sp.
DVDFDFAGPAIHG

SEQ ID NO: 13558 - protein, 15 aa, Mus sp.
DSYRSPWSNKYDPPL

SEQ ID NO: 13559 - protein, 16 aa, Mus sp.
DVVHGFYNPAVSRIVE

SEQ ID NO: 13560 - protein, 18 aa, Mus sp.
GDTIEFRGPNGLLVYQGK

SEQ ID NO: 13561 - protein, 17 aa, Mus sp.
DPELPQFIQAKVNAINM

SEQ ID NO: 13562 - protein, 16 aa, Mus sp.
MYQMYGGPVVLVAHSM

SEQ ID NO: 13563 - protein, 15 aa, Mus sp.
VGVNEYGLPMAVAQV

SEQ ID NO: 13564 - protein, 12 aa, Mus sp.
DEGERYIAPTVL

SEQ ID NO: 13565 - protein, 16 aa, Mus sp.
VGPDYAHAEARKSPAL

SEQ ID NO: 13566 - protein, 20 aa, Mus sp.
DGEEAGAYDGPRTADGIVSH

SEQ ID NO: 13567 - protein, 16 aa, Mus sp.
ADEPVWRSEQAIGAIA

SEQ ID NO: 13568 - protein, 14 aa, Mus sp.
AVKSKYKASIAALE

SEQ ID NO: 13569 - protein, 18 aa, Mus sp.
NKPEDYQGGRTGEAIVDA

SEQ ID NO: 13570 - protein, 16 aa, Mus sp.
LDLLDLAPEPRYAHIP

SEQ ID NO: 13571 - protein, 16 aa, Mus sp.
APLDELVGAYPNYNEE

SEQ ID NO: 13572 - protein, 16 aa, Mus sp.
DSPDVVYSPETIEARY

SEQ ID NO: 13573 - protein, 19 aa, Mus sp.
KPGTTVEYLAPWANQIDMA

SEQ ID NO: 13574 - protein, 17 aa, Mus sp.
RDLKWGTPVPLEGFEDK

SEQ ID NO: 13575 - protein, 19 aa, Mus sp.
EKPVPAAPVPSPVAPAPVP

SEQ ID NO: 13576 - protein, 17 aa, Mus sp.
GGYKPFQNPVPNQSPSS

SEQ ID NO: 13577 - protein, 12 aa, Mus sp.
IEVSSPITLQAL

SEQ ID NO: 13578 - protein, 14 aa, Mus sp.
SEVYTFPVPERHLE

SEQ ID NO: 13579 - protein, 18 aa, Mus sp.
RTDWEAPTGQPSAPGPRP

SEQ ID NO: 13580 - protein, 16 aa, Mus sp.
IEVDQIYHLASPASPP

SEQ ID NO: 13581 - protein, 15 aa, Mus sp.
GPGGLWVWGAPAVAQ

SEQ ID NO: 13582 - protein, 14 aa, Mus sp.
VDQIYHLASPASPP

SEQ ID NO: 13583 - protein, 14 aa, Mus sp.
FDIFYTAPQPGKYV

SEQ ID NO: 13584 - protein, 15 aa, Mus sp.
GKKFTAPHILIATGG

SEQ ID NO: 13585 - protein, 11 aa, Mus sp.
LPYDTPVPGYM

SEQ ID NO: 13586 - protein, 17 aa, Mus sp.
APQQAAAPEPTSAFNPR

SEQ ID NO: 13587 - protein, 16 aa, Mus sp.
YNPEAMVAPSVLSNIQ

SEQ ID NO: 13588 - protein, 13 aa, Mus sp.
KTQYISPNLNPND

SEQ ID NO: 13589 - protein, 13 aa, Mus sp.
GFVLLGATANEVR

SEQ ID NO: 13590 - protein, 14 aa, Mus sp.
YEWAPPVQNQALAR

SEQ ID NO: 13591 - protein, 11 aa, Mus sp.
DYFKGAIPIRK

SEQ ID NO: 13592 - protein, 14 aa, Mus sp.
ETFHASQPSLTVDG

SEQ ID NO: 13593 - protein, 15 aa, Mus sp.
GPGSAVSPYPSFNVS

SEQ ID NO: 13594 - protein, 14 aa, Mus sp.
VSWQEKQPEASISQ

SEQ ID NO: 13595 - protein, 15 aa, Mus sp.
ELPDIAPPLVTPDEP

SEQ ID NO: 13596 - protein, 19 aa, Mus sp.
KPKGQLPDYTSPVVLPYSR

SEQ ID NO: 13597 - protein, 16 aa, Mus sp.
ADKTVKGPDGLTALEA

SEQ ID NO: 13598 - protein, 17 aa, Mus sp.
DRSAWYMGPVTRQEAQT

SEQ ID NO: 13599 - protein, 14 aa, Mus sp.
GAWTGPMGNWAMFT

SEQ ID NO: 13600 - protein, 12 aa, Mus sp.
LVLDFVTPTPLG

SEQ ID NO: 13601 - protein, 13 aa, Mus sp.
HTLFHNPHVNPLP

SEQ ID NO: 13602 - protein, 23 aa, Mus sp.
GPSAPATPAAEAKAAEAAASAYY

SEQ ID NO: 13603 - protein, 13 aa, Mus sp.
LPSTWSDPSVNIS

SEQ ID NO: 13604 - protein, 14 aa, Mus sp.
DPAWEAPEGVPIDA

SEQ ID NO: 13605 - protein, 16 aa, Mus sp.
TSSYSNPTIGYENRVL

SEQ ID NO: 13606 - protein, 15 aa, Mus sp.
SKATYSTNSPVWEEA

SEQ ID NO: 13607 - protein, 12 aa, Mus sp.
DIFIGPKAEEHR

SEQ ID NO: 13608 - protein, 13 aa, Mus sp.
FVAPAVTPVKGVL

SEQ ID NO: 13609 - protein, 17 aa, Mus sp.
AINDYKGAVIVVSHDAR

SEQ ID NO: 13610 - protein, 16 aa, Mus sp.
GYAVYETPTAHNGAKN

SEQ ID NO: 13611 - protein, 15 aa, Mus sp.
KTPEIVAPESAHAAF

SEQ ID NO: 13612 - protein, 19 aa, Mus sp.
NFKKWVNTPFTASSIELVP

SEQ ID NO: 13613 - protein, 13 aa, Mus sp.
STTEFEEPRVIDL

SEQ ID NO: 13614 - protein, 16 aa, Mus sp.
GPYDFYQHPNVAEARQ

SEQ ID NO: 13615 - protein, 12 aa, Mus sp.
HTLFHNPHVNPL

SEQ ID NO: 13616 - protein, 16 aa, Mus sp.
LHLRFSAPQIENEPET

SEQ ID NO: 13617 - protein, 17 aa, Mus sp.
AFALQEQPVVNAVIDDA

SEQ ID NO: 13618 - protein, 15 aa, Mus sp.
GDLSQHATPLPTPAV

SEQ ID NO: 13619 - protein, 17 aa, Mus sp.
SLQAFSNPSAGISVDVK

SEQ ID NO: 13620 - protein, 21 aa, Mus sp.
LDPAGPNFEYAEAPSRLSPDD

SEQ ID NO: 13621 - protein, 17 aa, Mus sp.
GDLSQHATPLPTPAVLP

SEQ ID NO: 13622 - protein, 17 aa, Mus sp.
NRPAFMPSEGRMVSDIN

SEQ ID NO: 13623 - protein, 13 aa, Mus sp.
DARSYTAAVANRA

SEQ ID NO: 13624 - protein, 22 aa, Mus sp.
EPSPVSETVVTPEAAPEKNPVD

SEQ ID NO: 13625 - protein, 16 aa, Mus sp.
EGNTWLTAFVLKSFAQ

SEQ ID NO: 13626 - protein, 18 aa, Mus sp.
KGPAFVNPLIPENKEEEE

SEQ ID NO: 13627 - protein, 20 aa, Mus sp.
SPGFSSEVYTFPVPERHLER

SEQ ID NO: 13628 - protein, 18 aa, Mus sp.
VPDFSDYRRAEVLDSTKS

SEQ ID NO: 13629 - protein, 17 aa, Mus sp.
GNHTLFHNPHVNPLPTG

SEQ ID NO: 13630 - protein, 19 aa, Mus sp.
DPAVADLVKNPTASLVLPE

SEQ ID NO: 13631 - protein, 15 aa, Mus sp.
IVYWMTSQPSDAVRF

SEQ ID NO: 13632 - protein, 15 aa, Mus sp.
STPSYSIPEASFQDS

SEQ ID NO: 13633 - protein, 23 aa, Mus sp.
TPSPESPDQWSSSSPHSASDWSD

SEQ ID NO: 13634 - protein, 15 aa, Mus sp.
LDSQYRASAPNSHVP

SEQ ID NO: 13635 - protein, 14 aa, Mus sp.
VEPYEVHNPVPLIV

SEQ ID NO: 13636 - protein, 21 aa, Mus sp.
RKGEQIYYAGPVNNPGLDVPQ

SEQ ID NO: 13637 - protein, 21 aa, Mus sp.
APKETTIWVSPSPILEEGSPV

SEQ ID NO: 13638 - protein, 16 aa, Mus sp.
EPTGVYHQTTLHMALS

SEQ ID NO: 13639 - protein, 17 aa, Mus sp.
GDMPTKLRRLDVHANQE

SEQ ID NO: 13640 - protein, 15 aa, Mus sp.
LPNYSSPNALVLNTK

SEQ ID NO: 13641 - protein, 18 aa, Mus sp.
LPPHVYSTPQPSLPPVQP

SEQ ID NO: 13642 - protein, 13 aa, Mus sp.
RTWNDPSVQQDIK

SEQ ID NO: 13643 - protein, 15 aa, Mus sp.
KKWVNTPFTASSIEL

SEQ ID NO: 13644 - protein, 17 aa, Mus sp.
IEDRDHYIPNTLNPVFG

SEQ ID NO: 13645 - protein, 17 aa, Mus sp.
TTTVVHAPYPQPQPQPV

SEQ ID NO: 13646 - protein, 19 aa, Mus sp.
LITGVDFIGSTVGLAKVSA

SEQ ID NO: 13647 - protein, 14 aa, Mus sp.
LPYDTPVPGYMNNT

SEQ ID NO: 13648 - protein, 16 aa, Mus sp.
ETETVFAPVIQAGMEA

SEQ ID NO: 13649 - protein, 20 aa, Mus sp.
APPKPQDAFSDSQPASAAES

SEQ ID NO: 13650 - protein, 14 aa, Mus sp.
AGPQWADPQISESN

SEQ ID NO: 13651 - protein, 13 aa, Mus sp.
LEPYLEPRSPEAR

SEQ ID NO: 13652 - protein, 15 aa, Mus sp.
GNHTLFHNPHVNPLP

SEQ ID NO: 13653 - protein, 17 aa, Mus sp.
TTVSLSAPDALKIITEN

SEQ ID NO: 13654 - protein, 17 aa, Mus sp.
YSAFSYVDPVITSISPR

SEQ ID NO: 13655 - protein, 15 aa, Mus sp.
LPDYSAPNPIKVTHR

SEQ ID NO: 13656 - protein, 13 aa, Mus sp.
QIDYTVPTVIAEE

SEQ ID NO: 13657 - protein, 16 aa, Mus sp.
AVDALASSHPLSSPAD

SEQ ID NO: 13658 - protein, 14 aa, Mus sp.
KPVPAAPVPSPVAP

SEQ ID NO: 13659 - protein, 16 aa, Mus sp.
TTVEYLAPWANQIDMA

SEQ ID NO: 13660 - protein, 16 aa, Mus sp.
NINQWTASIVEQSITH

SEQ ID NO: 13661 - protein, 15 aa, Mus sp.
APHVAYMQPKANAPS

SEQ ID NO: 13662 - protein, 19 aa, Mus sp.
QPPPAYEPPAPAPAPLPPP

SEQ ID NO: 13663 - protein, 21 aa, Mus sp.
LPEEVGEYRQPSGGSVPVSPG

SEQ ID NO: 13664 - protein, 14 aa, Mus sp.
YTIPFYTPIPNGLY

SEQ ID NO: 13665 - protein, 15 aa, Mus sp.
TPRDYYFALAHTVRD

SEQ ID NO: 13666 - protein, 14 aa, Mus sp.
MAFRVPTPNVSVVD

SEQ ID NO: 13667 - protein, 14 aa, Mus sp.
KKAGYITPVPGGVG

SEQ ID NO: 13668 - protein, 16 aa, Mus sp.
VPWNFHEPQPGQYEFS

SEQ ID NO: 13669 - protein, 15 aa, Mus sp.
TPDYIAPEIIAYQPY

SEQ ID NO: 13670 - protein, 17 aa, Mus sp.
TGMAFRVPTPNVSVVDL

SEQ ID NO: 13671 - protein, 11 aa, Mus sp.
LPDYSAPNPIK

SEQ ID NO: 13672 - protein, 16 aa, Mus sp.
APMYYRGSAAAIIVYD

SEQ ID NO: 13673 - protein, 16 aa, Mus sp.
SARTVITPDPNLSIDQ

SEQ ID NO: 13674 - protein, 15 aa, Mus sp.
DMDGEWEAPQIANPK

SEQ ID NO: 13675 - protein, 20 aa, Mus sp.
TPPSPKVTYKAPVPTGEVYF

SEQ ID NO: 13676 - protein, 17 aa, Mus sp.
KAVDVFFPPEAQNDFPV

SEQ ID NO: 13677 - protein, 18 aa, Mus sp.
GPGGKWMIPPEAKESMDK

SEQ ID NO: 13678 - protein, 17 aa, Mus sp.
DPSAFAAAAPAAAATTA

SEQ ID NO: 13679 - protein, 15 aa, Mus sp.
FATGFSHPLTQSAVM

SEQ ID NO: 13680 - protein, 19 aa, Mus sp.
LPGNLDYWTYPGSLTTPPL

SEQ ID NO: 13681 - protein, 17 aa, Mus sp.
DSNFGAPSASVAAAPAP

SEQ ID NO: 13682 - protein, 16 aa, Mus sp.
RERYNFPNPNPFVEDD

SEQ ID NO: 13683 - protein, 14 aa, Mus sp.
EGDIFIGPKAEEHR

SEQ ID NO: 13684 - protein, 18 aa, Mus sp.
APLNVQFSSPLPGEAVKD

SEQ ID NO: 13685 - protein, 13 aa, Mus sp.
IDPYDQPNAIYIE

SEQ ID NO: 13686 - protein, 14 aa, Mus sp.
EELVITPLPSGDVA

SEQ ID NO: 13687 - protein, 16 aa, Mus sp.
SVPATFAPSPTPAVVS

SEQ ID NO: 13688 - protein, 17 aa, Mus sp.
LPQDPTFHTPLDLYAYA

SEQ ID NO: 13689 - protein, 15 aa, Mus sp.
LPFGAYTNPFATPAQ

SEQ ID NO: 13690 - protein, 15 aa, Mus sp.
ETETVFAPVIQAGME

SEQ ID NO: 13691 - protein, 24 aa, Mus sp.
FPGPNIGGDTHFDSAEPWTVQNED

SEQ ID NO: 13692 - protein, 11 aa, Mus sp.
SDWTNPEINKA

SEQ ID NO: 13693 - protein, 14 aa, Mus sp.
FDQGYEAPGVREAA

SEQ ID NO: 13694 - protein, 21 aa, Mus sp.
GIKADKADKAAASGPASASAP

SEQ ID NO: 13695 - protein, 16 aa, Mus sp.
AIVDPYNNPVPRGLEA

SEQ ID NO: 13696 - protein, 17 aa, Mus sp.
TVIHFNNPKVQASLAAN

SEQ ID NO: 13697 - protein, 15 aa, Mus sp.
GFPYEGPAPLEAIAN

SEQ ID NO: 13698 - protein, 13 aa, Mus sp.
VNWYAPLVAPISK

SEQ ID NO: 13699 - protein, 18 aa, Mus sp.
WDLVDAVTPSPQPSKEED

SEQ ID NO: 13700 - protein, 21 aa, Mus sp.
GKLTGMAFRVPTPNVSVVDLT

SEQ ID NO: 13701 - protein, 15 aa, Mus sp.
LPNVQVEGPTPNRPR

SEQ ID NO: 13702 - protein, 15 aa, Mus sp.
TNTAYVGSAILSEET

SEQ ID NO: 13703 - protein, 15 aa, Mus sp.
EEWGPFKAPHANRFI

SEQ ID NO: 13704 - protein, 23 aa, Mus sp.
LMEKIQASVATNPIITPVAQENQ

SEQ ID NO: 13705 - protein, 18 aa, Mus sp.
IDTAAKFIGAGAATVGVA

SEQ ID NO: 13706 - protein, 15 aa, Mus sp.
EPYMYLSPLQQAVSD

SEQ ID NO: 13707 - protein, 17 aa, Mus sp.
TSNDVHMYLPTKLFQPS

SEQ ID NO: 13708 - protein, 17 aa, Mus sp.
EPYAHAAPESIPATFED

SEQ ID NO: 13709 - protein, 24 aa, Mus sp.
LPNKPTVTVVSPLPNDSINPQPSP

SEQ ID NO: 13710 - protein, 16 aa, Mus sp.
FPLATYAPVISAEKAY

SEQ ID NO: 13711 - protein, 17 aa, Mus sp.
VTEDNVFEAPTLVKVFK

SEQ ID NO: 13712 - protein, 16 aa, Mus sp.
ERDSKIVVPPLPGKAL

SEQ ID NO: 13713 - protein, 8 aa, Mus sp.
VNFEFPEF

SEQ ID NO: 13714 - protein, 14 aa, Mus sp.
YKPFQNPVPNQSPS

SEQ ID NO: 13715 - protein, 13 aa, Mus sp.
TPEYLAPEVLEDN

SEQ ID NO: 13716 - protein, 16 aa, Mus sp.
KKAGYITPVPGGVGPM

SEQ ID NO: 13717 - protein, 15 aa, Mus sp.
SKIRYKTSEPVWEEN

SEQ ID NO: 13718 - protein, 12 aa, Mus sp.
DAEYWNSQPEIL

SEQ ID NO: 13719 - protein, 15 aa, Mus sp.
LDNYLTSPLPEEVDE

SEQ ID NO: 13720 - protein, 16 aa, Mus sp.
APGGYVAPKAVWLPAV

SEQ ID NO: 13721 - protein, 15 aa, Mus sp.
DFVAWATGEPNFAND

SEQ ID NO: 13722 - protein, 18 aa, Mus sp.
NPLNSVFVAPAVTPVKGV

SEQ ID NO: 13723 - protein, 16 aa, Mus sp.
EDRRYNPPIIHQGFQD

SEQ ID NO: 13724 - protein, 15 aa, Mus sp.
GSTLWSSPLPEEAQD

SEQ ID NO: 13725 - protein, 16 aa, Mus sp.
AGPQWADPQISESNFS

SEQ ID NO: 13726 - protein, 18 aa, Mus sp.
FHKLSYLTFIPSDDDIYD

SEQ ID NO: 13727 - protein, 17 aa, Mus sp.
APAPAPAAAPAPAPAAQ

SEQ ID NO: 13728 - protein, 19 aa, Mus sp.
GGDTHFDSAEPWTVQNEDL

SEQ ID NO: 13729 - protein, 13 aa, Mus sp.
LPYDTPVPGYMNN

SEQ ID NO: 13730 - protein, 14 aa, Mus sp.
EALFYNHALPLPGF

SEQ ID NO: 13731 - protein, 20 aa, Mus sp.
GPNDERFGVRFPAMSDAYDR

SEQ ID NO: 13732 - protein, 13 aa, Mus sp.
RSNEFDYPSVGQL

SEQ ID NO: 13733 - protein, 17 aa, Mus sp.
ESEEEYSAPLPTPAPSS

SEQ ID NO: 13734 - protein, 18 aa, Mus sp.
EAPSIFLDPETRQAMGEQ

SEQ ID NO: 13735 - protein, 15 aa, Mus sp.
IFYGASIASLSASHS

SEQ ID NO: 13736 - protein, 13 aa, Mus sp.
TVEYLAPWANQID

SEQ ID NO: 13737 - protein, 15 aa, Mus sp.
ENDIYNFFSPLNPVR

SEQ ID NO: 13738 - protein, 16 aa, Mus sp.
SEWKFTITPPSAQVVG

SEQ ID NO: 13739 - protein, 15 aa, Mus sp.
GSVTYIAPPGNYDAS

SEQ ID NO: 13740 - protein, 17 aa, Mus sp.
SPTGNIFFSPFSISSAL

SEQ ID NO: 13741 - protein, 15 aa, Mus sp.
NNIPYFETSAKEAIN

SEQ ID NO: 13742 - protein, 15 aa, Mus sp.
YEDKVYWTDVINEAI

SEQ ID NO: 13743 - protein, 15 aa, Mus sp.
SCKYSHLITSHQFQP

SEQ ID NO: 13744 - protein, 14 aa, Mus sp.
APTSALGPKASPAP

SEQ ID NO: 13745 - protein, 17 aa, Mus sp.
AREGSYEAAKILLDHFA

SEQ ID NO: 13746 - protein, 14 aa, Mus sp.
SSVAFIKPGVNKAE

SEQ ID NO: 13747 - protein, 17 aa, Mus sp.
APSNTFVAPQPVVASPA

SEQ ID NO: 13748 - protein, 16 aa, Mus sp.
GTVIHFNNPKVQASLA

SEQ ID NO: 13749 - protein, 18 aa, Mus sp.
IDTSLKAPDVDVSVAGPD

SEQ ID NO: 13750 - protein, 17 aa, Mus sp.
NPLNSVFVAPAVTPVKG

SEQ ID NO: 13751 - protein, 17 aa, Mus sp.
EGNHYFYSPYPTKTQTM

SEQ ID NO: 13752 - protein, 18 aa, Mus sp.
VGGERFEAPEALFQPHLI

SEQ ID NO: 13753 - protein, 20 aa, Mus sp.
FEDYVELPPSVSQAATSPPG

SEQ ID NO: 13754 - protein, 18 aa, Mus sp.
AGHFRSPHTTEVVGGAPQ

SEQ ID NO: 13755 - protein, 17 aa, Mus sp.
KNLDYVATSIHEAVTKI

SEQ ID NO: 13756 - protein, 14 aa, Mus sp.
APPHFHFGQTNRTP

SEQ ID NO: 13757 - protein, 17 aa, Mus sp.
SKPSFHAPEPKPHYDPA

SEQ ID NO: 13758 - protein, 13 aa, Mus sp.
KNLDYVATSIHEA

SEQ ID NO: 13759 - protein, 22 aa, Mus sp.
GGDPEAPAPAPAAERPPAPGPG

SEQ ID NO: 13760 - protein, 15 aa, Mus sp.
SRGEYSWAVAQGVKQ

SEQ ID NO: 13761 - protein, 14 aa, Mus sp.
FPYEGPAPLEAIAN

SEQ ID NO: 13762 - protein, 15 aa, Mus sp.
VPATFAPSPTPAVVS

SEQ ID NO: 13763 - protein, 15 aa, Mus sp.
FVAWATGEPNFANDD

SEQ ID NO: 13764 - protein, 23 aa, Mus sp.
APTPSTPAPTPAATPAASPAPVS

SEQ ID NO: 13765 - protein, 17 aa, Mus sp.
KDPFWWNGAEPIWVTNQ

SEQ ID NO: 13766 - protein, 16 aa, Mus sp.
SNDVHMYLPTKLFQPS

SEQ ID NO: 13767 - protein, 13 aa, Mus sp.
TPYYVAPEVLGPE

SEQ ID NO: 13768 - protein, 15 aa, Mus sp.
IPPTHYAASRAASVA

SEQ ID NO: 13769 - protein, 12 aa, Mus sp.
IEGYVPSQADVA

SEQ ID NO: 13770 - protein, 15 aa, Mus sp.
IDQYQGADAVGLEEK

SEQ ID NO: 13771 - protein, 17 aa, Mus sp.
IASFKDPKISTSLPVLD

SEQ ID NO: 13772 - protein, 15 aa, Mus sp.
TSDIFGSPVTATAPL

SEQ ID NO: 13773 - protein, 17 aa, Mus sp.
GQNAWFLPAQADIVATK

SEQ ID NO: 13774 - protein, 15 aa, Mus sp.
GTVIHFNNPKVQASL

SEQ ID NO: 13775 - protein, 14 aa, Mus sp.
EPYEVHNPVPLIVG

SEQ ID NO: 13776 - protein, 15 aa, Mus sp.
EQFVYSSPHDNKSWE

SEQ ID NO: 13777 - protein, 13 aa, Mus sp.
ADKEFHAPLIIDE

SEQ ID NO: 13778 - protein, 15 aa, Mus sp.
AISYVAALPAAALWH

SEQ ID NO: 13779 - protein, 18 aa, Mus sp.
DTSSKVIQSVANYAKGDL

SEQ ID NO: 13780 - protein, 17 aa, Mus sp.
IPPTHYAASRAASVAEN

SEQ ID NO: 13781 - protein, 14 aa, Mus sp.
APYQGPDAAPGALD

SEQ ID NO: 13782 - protein, 18 aa, Mus sp.
GPASEWTFSTPEGVPGHP

SEQ ID NO: 13783 - protein, 15 aa, Mus sp.
GGYKFSAPVVPSSFN

SEQ ID NO: 13784 - protein, 16 aa, Mus sp.
KPSPIYISSYSSPARE

SEQ ID NO: 13785 - protein, 16 aa, Mus sp.
TNDRYVASLAARNKVG

SEQ ID NO: 13786 - protein, 17 aa, Mus sp.
QPPEYTFPSGSGAHFPQ

SEQ ID NO: 13787 - protein, 13 aa, Mus sp.
AEQEVLAPQVVLS

SEQ ID NO: 13788 - protein, 17 aa, Mus sp.
IPEAQWQSSLARTSSAE

SEQ ID NO: 13789 - protein, 18 aa, Mus sp.
ATPAPSAPAAASATSPSP

SEQ ID NO: 13790 - protein, 13 aa, Mus sp.
LFPQYTAPSILPS

SEQ ID NO: 13791 - protein, 15 aa, Mus sp.
IEHLYKNPQAHIEGN

SEQ ID NO: 13792 - protein, 15 aa, Mus sp.
NLDYWTYPGSLTTPP

SEQ ID NO: 13793 - protein, 16 aa, Mus sp.
FVAWATGEPNFANDDE

SEQ ID NO: 13794 - protein, 21 aa, Mus sp.
VDPTPDPNTAYASYPSASVEN

SEQ ID NO: 13795 - protein, 13 aa, Mus sp.
RDYVPPTANLDQK

SEQ ID NO: 13796 - protein, 16 aa, Mus sp.
TRSQVTPSVPSEALDD

SEQ ID NO: 13797 - protein, 14 aa, Mus sp.
IGDSNFGAPSASVA

SEQ ID NO: 13798 - protein, 18 aa, Mus sp.
GNPLNSVFVAPAVTPVKG

SEQ ID NO: 13799 - protein, 27 aa, Mus sp.
LSPDDADFVDVLHTFTRGSPGRSIGIQ

SEQ ID NO: 13800 - protein, 16 aa, Mus sp.
VGPVPWLGPQTDEAIK

SEQ ID NO: 13801 - protein, 16 aa, Mus sp.
TRPHWLEPTIYSSEED

SEQ ID NO: 13802 - protein, 14 aa, Mus sp.
KFDEWVAPTPEVAD

SEQ ID NO: 13803 - protein, 12 aa, Mus sp.
LFHNPHVNPLPT

SEQ ID NO: 13804 - protein, 18 aa, Mus sp.
DPKLTYHGFTLEDAASPK

SEQ ID NO: 13805 - protein, 18 aa, Mus sp.
VHKSFVEVNEEGTEAAAA

SEQ ID NO: 13806 - protein, 16 aa, Mus sp.
EDLNYHDPTVKHSTFH

SEQ ID NO: 13807 - protein, 17 aa, Mus sp.
DIRSDWTNPEINKAVLH

SEQ ID NO: 13808 - protein, 14 aa, Mus sp.
LLYNVPAVAEEIQD

SEQ ID NO: 13809 - protein, 14 aa, Mus sp.
KRYMAPEVLDDSIN

SEQ ID NO: 13810 - protein, 9 aa, Mus sp.
IPFYTPIPN

SEQ ID NO: 13811 - protein, 14 aa, Mus sp.
FDNYEGSAPNLYVW

SEQ ID NO: 13812 - protein, 16 aa, Mus sp.
EVAFNGPKGGYVALDD

SEQ ID NO: 13813 - protein, 16 aa, Mus sp.
AGEFDYSGSQAIKALK

SEQ ID NO: 13814 - protein, 23 aa, Mus sp.
ADHVGTYGISVYQSPGDIGQYTF

SEQ ID NO: 13815 - protein, 16 aa, Mus sp.
LDEYLNSPLPDEIDEN

SEQ ID NO: 13816 - protein, 16 aa, Mus sp.
GKITTDYNSPEAGNIF

SEQ ID NO: 13817 - protein, 17 aa, Mus sp.
EYPDSWSTPHSYFSLKF

SEQ ID NO: 13818 - protein, 20 aa, Mus sp.
AQPTGPPPYHESLAGASQPP

SEQ ID NO: 13819 - protein, 17 aa, Mus sp.
LDIYVWRGAQATLSNTT

SEQ ID NO: 13820 - protein, 14 aa, Mus sp.
KIGEHTPSALAIME

SEQ ID NO: 13821 - protein, 12 aa, Mus sp.
YKVHNPVPLIVG

SEQ ID NO: 13822 - protein, 19 aa, Mus sp.
IGGDTHFDSAEPWTVQNED

SEQ ID NO: 13823 - protein, 16 aa, Mus sp.
DDDFEPYLSPQARPNN

SEQ ID NO: 13824 - protein, 11 aa, Mus sp.
TLVTYVPVTTF

SEQ ID NO: 13825 - protein, 20 aa, Mus sp.
VPPTPQPVAPTPSAAPAGPK

SEQ ID NO: 13826 - protein, 12 aa, Mus sp.
VTPWKAPIVWEG

SEQ ID NO: 13827 - protein, 19 aa, Mus sp.
DDPTAGHSNAPIAAPAEVE

SEQ ID NO: 13828 - protein, 14 aa, Mus sp.
DKDSFSDPYAHVSF

SEQ ID NO: 13829 - protein, 14 aa, Mus sp.
LGEFDTPEAIWSSE

SEQ ID NO: 13830 - protein, 15 aa, Mus sp.
ADDYTTANARKLIDE

SEQ ID NO: 13831 - protein, 16 aa, Mus sp.
KVNAVFSPKAASSPED

SEQ ID NO: 13832 - protein, 24 aa, Mus sp.
WSFMGALSVVLPCLLCYLPATGCV

SEQ ID NO: 13833 - protein, 12 aa, Mus sp.
EPYLEPRSPEAR

SEQ ID NO: 13834 - protein, 19 aa, Mus sp.
HSMRYFETAVSRPGLEEPR

SEQ ID NO: 13835 - protein, 18 aa, Mus sp.
DYVELPPSVSQAAKSPPG

SEQ ID NO: 13836 - protein, 15 aa, Mus sp.
GNHYFYSPYPTKTQT

SEQ ID NO: 13837 - protein, 15 aa, Mus sp.
GKFIYITPEELAAVA

SEQ ID NO: 13838 - protein, 12 aa, Mus sp.
DEATRYLAPTIL

SEQ ID NO: 13839 - protein, 13 aa, Mus sp.
APYQGPDAAPGAL

SEQ ID NO: 13840 - protein, 14 aa, Mus sp.
EVNSQYQEPDIIIH

SEQ ID NO: 13841 - protein, 13 aa, Mus sp.
NAANVGWNGSTFA

SEQ ID NO: 13842 - protein, 15 aa, Mus sp.
EVNSQYQEPDIIIHF

SEQ ID NO: 13843 - protein, 16 aa, Mus sp.
KPSTFAYPAPLEVPKE

SEQ ID NO: 13844 - protein, 18 aa, Mus sp.
EKPVPAAPVPSPVAPAPV

SEQ ID NO: 13845 - protein, 19 aa, BOVIN
APSAVPDAAGPTPSAAGPP

SEQ ID NO: 13846 - protein, 17 aa, Mus sp.
KKWVNTPFTASSIELVP

SEQ ID NO: 13847 - protein, 13 aa, Mus sp.
NSEFDPPGPNVAT

SEQ ID NO: 13848 - protein, 8 aa, Mus sp.
TIIIFHSL

SEQ ID NO: 13849 - protein, 16 aa, Mus sp.
IFNKFKFPAAVVVEDD

SEQ ID NO: 13850 - protein, 15 aa, Mus sp.
AEDVTFIGPDTHAIQ

SEQ ID NO: 13851 - protein, 15 aa, BOVIN
GAEAEAPSAVPDAAG

SEQ ID NO: 13852 - protein, 15 aa, Mus sp.
RASIYQSVVINTSKE

SEQ ID NO: 13853 - protein, 16 aa, Mus sp.
DGYPVLYPTGWSSSDN

SEQ ID NO: 13854 - protein, 13 aa, Mus sp.
DNYRFAHTNIESL

SEQ ID NO: 13855 - protein, 16 aa, Mus sp.
LNLAYIGAVPHSGIEQ

SEQ ID NO: 13856 - protein, 15 aa, Mus sp.
STDYGNFLANEASPL

SEQ ID NO: 13857 - protein, 19 aa, Mus sp.
VTEDNVFEAPTLVKVFKQP

SEQ ID NO: 13858 - protein, 15 aa, Mus sp.
LSLKYHFVTPLTSMV

SEQ ID NO: 13859 - protein, 19 aa, Mus sp.
KIPEVDMARVVAPFMSNIP

SEQ ID NO: 13860 - protein, 17 aa, Mus sp.
VHKSFVEVNEEGTEAAA

SEQ ID NO: 13861 - protein, 20 aa, Mus sp.
LPDLTNIHFPSPLPTPLDPE

SEQ ID NO: 13862 - protein, 14 aa, Mus sp.
GKWKYEKPDGSPVF

SEQ ID NO: 13863 - protein, 16 aa, Mus sp.
AGMAVFTPVINGVGGN

SEQ ID NO: 13864 - protein, 17 aa, Mus sp.
NPEKHIYSSITTWETTE

SEQ ID NO: 13865 - protein, 17 aa, Mus sp.
GTPEYLAPEIILSKGYN

SEQ ID NO: 13866 - protein, 15 aa, Mus sp.
NLLLQSPGVLTAARE

SEQ ID NO: 13867 - protein, 16 aa, Mus sp.
VKVIYKAPSENWAMEG

SEQ ID NO: 13868 - protein, 17 aa, Mus sp.
INMKQYASPMPTQTDVK

SEQ ID NO: 13869 - protein, 15 aa, Mus sp.
APPHFHFGQTNRTPE

SEQ ID NO: 13870 - protein, 16 aa, Mus sp.
VNGKKFTAPHILIATG

SEQ ID NO: 13871 - protein, 23 aa, Mus sp.
DKNGNPLNSVFVAPAVTPVKGVL

SEQ ID NO: 13872 - protein, 15 aa, Mus sp.
VQPYSGSPANLAAYT

SEQ ID NO: 13873 - protein, 18 aa, Mus sp.
FPTLKFFPASADRTVIDY

SEQ ID NO: 13874 - protein, 15 aa, Mus sp.
APAPEFTAAQPEVAD

SEQ ID NO: 13875 - protein, 19 aa, Mus sp.
YPPSGPTYRGPVPWHTINL

SEQ ID NO: 13876 - protein, 17 aa, Mus sp.
WGIDPYDQPNAIYIERH

SEQ ID NO: 13877 - protein, 21 aa, Mus sp.
GQDHVDFSQPEPHTVLFHEPG

SEQ ID NO: 13878 - protein, 14 aa, Mus sp.
PSYYTQPVPVPNAN

SEQ ID NO: 13879 - protein, 18 aa, Mus sp.
NPEKHIYSSITTWETTER

SEQ ID NO: 13880 - protein, 15 aa, Mus sp.
IYYAGPVNNPGLDVP

SEQ ID NO: 13881 - protein, 16 aa, Mus sp.
FKKWVNTPFTASSIEL

SEQ ID NO: 13882 - protein, 16 aa, Mus sp.
FDQGYEAPGVREAAAA

SEQ ID NO: 13883 - protein, 14 aa, Mus sp.
DRRYNPPIIHQGFQ

SEQ ID NO: 13884 - protein, 26 aa, Mus sp.
APAPAAPAAAEPQAEAPAAAASSEQS

SEQ ID NO: 13885 - protein, 15 aa, Mus sp.
LSEGFSSPSSLMSPS

SEQ ID NO: 13886 - protein, 18 aa, Mus sp.
KFGNSEFDPPGPNVATTT

SEQ ID NO: 13887 - protein, 12 aa, Mus sp.
VSYYGPKTSPVQ

SEQ ID NO: 13888 - protein, 12 aa, Mus sp.
DSERHFVYQFMG

SEQ ID NO: 13889 - protein, 14 aa, Mus sp.
YAVDIRSPAISWVN

SEQ ID NO: 13890 - protein, 16 aa, Mus sp.
AVPPVFTQPTANIMPS

SEQ ID NO: 13891 - protein, 14 aa, Mus sp.
DKFWGPSGAESVIG

SEQ ID NO: 13892 - protein, 15 aa, Mus sp.
VPAPATTPAPTPAPA

SEQ ID NO: 13893 - protein, 14 aa, Mus sp.
ERASFITPVPGGVG

SEQ ID NO: 13894 - protein, 15 aa, Mus sp.
DSVVFAGPAGNSVET

SEQ ID NO: 13895 - protein, 14 aa, Mus sp.
WKFTITPPSAQVVG

SEQ ID NO: 13896 - protein, 15 aa, Mus sp.
SSIASFKDPKISTSL

SEQ ID NO: 13897 - protein, 15 aa, Mus sp.
TSSLAAPTVEAAASA

SEQ ID NO: 13898 - protein, 14 aa, Mus sp.
DSYRSPWSNKYDPP

SEQ ID NO: 13899 - protein, 13 aa, Mus sp.
GTPDYIAPEILQG

SEQ ID NO: 13900 - protein, 15 aa, Mus sp.
SVTYYGPSGQKTIYS

SEQ ID NO: 13901 - protein, 17 aa, Mus sp.
APPAGSLYSSPVNSSAP

SEQ ID NO: 13902 - protein, 16 aa, Mus sp.
DVSAYIPTNVISITDG

SEQ ID NO: 13903 - protein, 19 aa, Mus sp.
DDERVVGFHVLGPNAGEVT

SEQ ID NO: 13904 - protein, 18 aa, Mus sp.
VLRYNITHPVVNDADASL

SEQ ID NO: 13905 - protein, 23 aa, Mus sp.
GPPGFEDYVELPPSVSQAAKSPP

SEQ ID NO: 13906 - protein, 17 aa, Mus sp.
TGPPPYHESLAGASQPP

SEQ ID NO: 13907 - protein, 25 aa, Mus sp.
DAGTIAGLNVMRIINEPTAAAIAYG

SEQ ID NO: 13908 - protein, 17 aa, Mus sp.
DDDVYRAPPIDRSILPT

SEQ ID NO: 13909 - protein, 14 aa, Mus sp.
LSYNEPLSLKTEAF

SEQ ID NO: 13910 - protein, 15 aa, Mus sp.
ADHFEIRFPLALDVK

SEQ ID NO: 13911 - protein, 15 aa, Mus sp.
IARQNFTEPTAIQAQ

SEQ ID NO: 13912 - protein, 17 aa, Mus sp.
GSVHTYVGGLPEVSVIS

SEQ ID NO: 13913 - protein, 14 aa, Mus sp.
IPVYRFVLPANAFA

SEQ ID NO: 13914 - protein, 13 aa, Mus sp.
LRDNYRFAHTNIE

SEQ ID NO: 13915 - protein, 15 aa, Mus sp.
WDRKMYYASKAMPAE

SEQ ID NO: 13916 - protein, 13 aa, Mus sp.
DAYHFFSPEPLNS

SEQ ID NO: 13917 - protein, 14 aa, Mus sp.
FEVQWQSAEPGSTP

SEQ ID NO: 13918 - protein, 14 aa, Mus sp.
AEEYEFLTPMEEAP

SEQ ID NO: 13919 - protein, 15 aa, Mus sp.
YDVYRYLPPATQVVL

SEQ ID NO: 13920 - protein, 17 aa, Mus sp.
KPPSYNVATTLPSYDEA

SEQ ID NO: 13921 - protein, 17 aa, Mus sp.
VGPVPWLGPQTDEAIKG

SEQ ID NO: 13922 - protein, 15 aa, Mus sp.
GINYQPPTVVPGGDL

SEQ ID NO: 13923 - protein, 16 aa, Mus sp.
RMAPYQGPDAAPGALD

SEQ ID NO: 13924 - protein, 17 aa, Mus sp.
DGNHTLFHNPHVNPLPT

SEQ ID NO: 13925 - protein, 18 aa, Mus sp.
KVEPYEVHNPVPLIVGSS

SEQ ID NO: 13926 - protein, 13 aa, Mus sp.
GGLPDYSAPNPIK

SEQ ID NO: 13927 - protein, 16 aa, Mus sp.
LRYNITHPVVNDADAS

SEQ ID NO: 13928 - protein, 19 aa, Mus sp.
APETRSQVTPSVPSEALDD

SEQ ID NO: 13929 - protein, 18 aa, Mus sp.
DPTAGHSNAPIAAPAEVE

SEQ ID NO: 13930 - protein, 14 aa, Mus sp.
NYEYYASHVPESVK

SEQ ID NO: 13931 - protein, 16 aa, Mus sp.
KPTVTVVSPLPNDSIN

SEQ ID NO: 13932 - protein, 15 aa, Mus sp.
SFKDPKISTSLPVLD

SEQ ID NO: 13933 - protein, 22 aa, Mus sp.
TPARAPETRSQVTPSVPSEALD

SEQ ID NO: 13934 - protein, 17 aa, Mus sp.
APAAAATTAAPAAAAAP

SEQ ID NO: 13935 - protein, 15 aa, Mus sp.
GSVLWERPVAQDVAL

SEQ ID NO: 13936 - protein, 17 aa, Mus sp.
LSLLYNVPAVAEEIQDE

SEQ ID NO: 13937 - protein, 13 aa, Mus sp.
EVQWQSAEPGSTP

SEQ ID NO: 13938 - protein, 15 aa, Mus sp.
IWRDYVPPTANLDQK

SEQ ID NO: 13939 - protein, 21 aa, Mus sp.
GPEAPLDELVGAYPNYNEEEE

SEQ ID NO: 13940 - protein, 12 aa, Mus sp.
VDFIGSTVGLAK

SEQ ID NO: 13941 - protein, 14 aa, Mus sp.
SPDVVYSPETIEAR

SEQ ID NO: 13942 - protein, 15 aa, Mus sp.
DRQVWSGSKAAGAPP

SEQ ID NO: 13943 - protein, 16 aa, Mus sp.
DIDSFVPSKAAPAAAA

SEQ ID NO: 13944 - protein, 20 aa, Mus sp.
KNPTDAYLDAMMNEAPGPIN

SEQ ID NO: 13945 - protein, 17 aa, Mus sp.
NKPEDYQGGRTGEAIVD

SEQ ID NO: 13946 - protein, 17 aa, Mus sp.
KVLPTYDASKVTASGPG

SEQ ID NO: 13947 - protein, 14 aa, Mus sp.
GPPPGWEGPHPQRG

SEQ ID NO: 13948 - protein, 13 aa, Mus sp.
GKKFTAPHILIAT

SEQ ID NO: 13949 - protein, 11 aa, Mus sp.
DYVPPTANLDQ

SEQ ID NO: 13950 - protein, 14 aa, Mus sp.
DAIQFATGMANALE

SEQ ID NO: 13951 - protein, 16 aa, Mus sp.
DINAFVGAVSLTAADS

SEQ ID NO: 13952 - protein, 15 aa, Mus sp.
NVLRIINEPTAAAIA

SEQ ID NO: 13953 - protein, 16 aa, Mus sp.
EMYKVHNPVPLIVGSS

SEQ ID NO: 13954 - protein, 14 aa, Mus sp.
EDYVELPPSVSQAA

SEQ ID NO: 13955 - protein, 13 aa, Mus sp.
VKDGYQMAQPVFA

SEQ ID NO: 13956 - protein, 9 aa, Mus sp.
AVYTFETLL

SEQ ID NO: 13957 - protein, 13 aa, Mus sp.
ETFNTPAMYVAIQ

SEQ ID NO: 13958 - protein, 15 aa, Mus sp.
LVQTYVGAISNGSLP

SEQ ID NO: 13959 - protein, 19 aa, Mus sp.
ADWQGGVYASPSIAGSRPG

SEQ ID NO: 13960 - protein, 24 aa, Mus sp.
LPDGRIIKVGGERFEAPEALFQPH

SEQ ID NO: 13961 - protein, 16 aa, Mus sp.
LPETFRRPQIDPAVEG

SEQ ID NO: 13962 - protein, 15 aa, Mus sp.
ATLEIKGPQADLIDA

SEQ ID NO: 13963 - protein, 16 aa, Mus sp.
DDIRSDWTNPEINKAV

SEQ ID NO: 13964 - protein, 14 aa, Mus sp.
YYRYMNPAIVAPDA

SEQ ID NO: 13965 - protein, 8 aa, Mus sp.
SALIYSNL

SEQ ID NO: 13966 - protein, 21 aa, Mus sp.
GPGEPSPVSETVVTPEAAPEK

SEQ ID NO: 13967 - protein, 14 aa, Mus sp.
DNYRFAHTNIESLV

SEQ ID NO: 13968 - protein, 14 aa, Mus sp.
LSRFTSGVPSFVLD

SEQ ID NO: 13969 - protein, 16 aa, Mus sp.
EMNLMHAPQVADAILG

SEQ ID NO: 13970 - protein, 17 aa, Mus sp.
ITPSYYTTSDAVISTET

SEQ ID NO: 13971 - protein, 15 aa, Mus sp.
LPYKSPGINVDSSYK

SEQ ID NO: 13972 - protein, 17 aa, Mus sp.
IEQFVYSSPHDNKSWEM

SEQ ID NO: 13973 - protein, 19 aa, Mus sp.
ETKKFRFEEPVVLPDLSDQ

SEQ ID NO: 13974 - protein, 16 aa, Mus sp.
MAFRVPTPNVSVVDLT

SEQ ID NO: 13975 - protein, 27 aa, Mus sp.
GDQGRDGIPGPPGEKGETGLLGAYPGP

SEQ ID NO: 13976 - protein, 17 aa, Mus sp.
YGIPFAAPTALASRDGN

SEQ ID NO: 13977 - protein, 14 aa, Mus sp.
TVIHFNNPKVQASL

SEQ ID NO: 13978 - protein, 15 aa, Mus sp.
YPNSFSAPEQQRSAL

SEQ ID NO: 13979 - protein, 20 aa, Mus sp.
APAATDEAAASAAPAASPEP

SEQ ID NO: 13980 - protein, 8 aa, Mus sp.
AAYEFTTL

SEQ ID NO: 13981 - protein, 17 aa, Mus sp.
YAKVELVPPTPAEIPTA

SEQ ID NO: 13982 - protein, 14 aa, Mus sp.
GLPDYSAPNPIKVT

SEQ ID NO: 13983 - protein, 24 aa, Mus sp.
GPGEPSPVSETVVTPEAAPEKNPV

SEQ ID NO: 13984 - protein, 14 aa, Mus sp.
FFWNVAPGAESAVA

SEQ ID NO: 13985 - protein, 18 aa, Mus sp.
IDNSKEFEFIESQTSSHR

SEQ ID NO: 13986 - protein, 22 aa, Mus sp.
WDLVDAVTPSPQPSKEEDGPPA

SEQ ID NO: 13987 - protein, 16 aa, Mus sp.
EGPEASTPMPSPSPSP

SEQ ID NO: 13988 - protein, 17 aa, Mus sp.
DVVDRVLKSPVASIVYE

SEQ ID NO: 13989 - protein, 16 aa, Mus sp.
YPFDFQGAKIITGQEE

SEQ ID NO: 13990 - protein, 19 aa, Mus sp.
EQPGLNGAAAAAAAEAPDE

SEQ ID NO: 13991 - protein, 19 aa, Mus sp.
LPQDPTFHTPLDLYAYARA

SEQ ID NO: 13992 - protein, 18 aa, Mus sp.
RSFFWNVAPGAESAVASF

SEQ ID NO: 13993 - protein, 17 aa, Mus sp.
LIGRTWNDPSVQQDIKF

SEQ ID NO: 13994 - protein, 19 aa, Mus sp.
LPPASLPESTPVPSSSPPP

SEQ ID NO: 13995 - protein, 20 aa, Mus sp.
GAEIEYAMAYSKAAFERESD

SEQ ID NO: 13996 - protein, 15 aa, Mus sp.
ALPYDTPVPGYMNNT

SEQ ID NO: 13997 - protein, 13 aa, Mus sp.
RYMAPEVLESRMN

SEQ ID NO: 13998 - protein, 18 aa, Mus sp.
NGNPLNSVFVAPAVTPVK

SEQ ID NO: 13999 - protein, 22 aa, Mus sp.
EQLPNVQVEGPTPNRPRKQLPS

SEQ ID NO: 14000 - protein, 15 aa, Mus sp.
VSVEFIAPTLEGTYT

SEQ ID NO: 14001 - protein, 14 aa, Mus sp.
FTYQQPQPLSVEPR

SEQ ID NO: 14002 - protein, 16 aa, Mus sp.
LPANAFASPLQNPDNH

SEQ ID NO: 14003 - protein, 16 aa, Mus sp.
SAFSYVDPVITSISPR

SEQ ID NO: 14004 - protein, 15 aa, Mus sp.
FGTGHSAPSASPAFG

SEQ ID NO: 14005 - protein, 13 aa, Mus sp.
TVHWVAPRAPITG

SEQ ID NO: 14006 - protein, 16 aa, Mus sp.
RPEEVEAEAVNRSITI

SEQ ID NO: 14007 - protein, 16 aa, Mus sp.
HDLDFRAPHVLVLGSG

SEQ ID NO: 14008 - protein, 16 aa, Mus sp.
EGDIFIGPKAEEHRGL

SEQ ID NO: 14009 - protein, 26 aa, Mus sp.
GEGGEATEQPGLNGAAAAAAAEAPDE

SEQ ID NO: 14010 - protein, 15 aa, Mus sp.
KVPYVAQEIQEEIDE

SEQ ID NO: 14011 - protein, 18 aa, Mus sp.
APAAATSAPAPAPAPAPA

SEQ ID NO: 14012 - protein, 10 aa, Mus sp.
LDYYDSPSVN

SEQ ID NO: 14013 - protein, 17 aa, Mus sp.
SPHPYQLPQALAPHVDF

SEQ ID NO: 14014 - protein, 18 aa, Mus sp.
LPETFRRPQIDPAVEGFI

SEQ ID NO: 14015 - protein, 15 aa, Mus sp.
KIGEHTPSALAIMEN

SEQ ID NO: 14016 - protein, 15 aa, Mus sp.
GSPNYAAPEVISGRL

SEQ ID NO: 14017 - protein, 15 aa, Mus sp.
SDPRWAESVPQEAPG

SEQ ID NO: 14018 - protein, 13 aa, Mus sp.
VTQFHPPHIEIQM

SEQ ID NO: 14019 - protein, 17 aa, Mus sp.
EVNSQYQEPDIIIHFAR

SEQ ID NO: 14020 - protein, 17 aa, Mus sp.
SPGILQASPTPLLAAAA

SEQ ID NO: 14021 - protein, 18 aa, Mus sp.
GELTYENVQVSPVPGGPP

SEQ ID NO: 14022 - protein, 14 aa, Mus sp.
VQTYVGAISNGSLP

SEQ ID NO: 14023 - protein, 19 aa, Mus sp.
IGDTIEFRGPNGLLVYQGK

SEQ ID NO: 14024 - protein, 16 aa, Mus sp.
TPAPTPAATPAASPAP

SEQ ID NO: 14025 - protein, 15 aa, Mus sp.
ITGVDFIGSTVGLAK

SEQ ID NO: 14026 - protein, 15 aa, Mus sp.
SFPKFKGSLALRTLD

SEQ ID NO: 14027 - protein, 14 aa, Mus sp.
INPEEYEHPNPWKE

SEQ ID NO: 14028 - protein, 17 aa, Mus sp.
SVPVTKTNLPNPSVDVK

SEQ ID NO: 14029 - protein, 17 aa, Mus sp.
VEPGNFIAATSLYSPER

SEQ ID NO: 14030 - protein, 15 aa, Mus sp.
SLVSWVGSEPMPEAG

SEQ ID NO: 14031 - protein, 16 aa, Mus sp.
VRIDQYQGADAVGLEE

SEQ ID NO: 14032 - protein, 16 aa, Mus sp.
GIPVYRFVLPANAFAS

SEQ ID NO: 14033 - protein, 15 aa, Mus sp.
TPSYYTTSDAVISTE

SEQ ID NO: 14034 - protein, 16 aa, Mus sp.
KLGMLTIGVDLQGVLM

SEQ ID NO: 14035 - protein, 15 aa, Mus sp.
IDWREPEGKEVWDYV

SEQ ID NO: 14036 - protein, 13 aa, Mus sp.
LEEQLGPVAEETR

SEQ ID NO: 14037 - protein, 14 aa, Mus sp.
DHPGNYVEPTIVTG

SEQ ID NO: 14038 - protein, 12 aa, Mus sp.
EAGAFNAPVINR

SEQ ID NO: 14039 - protein, 16 aa, Mus sp.
HNTEFKDSTYDLPRSL

SEQ ID NO: 14040 - protein, 17 aa, Mus sp.
EGEMTLKSALALAVKVL

SEQ ID NO: 14041 - protein, 14 aa, Mus sp.
AFRVPTPNVSVVDL

SEQ ID NO: 14042 - protein, 15 aa, Mus sp.
EGEMTLKSALALAVK

SEQ ID NO: 14043 - protein, 16 aa, Mus sp.
MKVEYHFLSPYVSPRE

SEQ ID NO: 14044 - protein, 17 aa, Mus sp.
NSNKQYLFPETLVIGEK

SEQ ID NO: 14045 - protein, 17 aa, Mus sp.
DPKLTYHGFTLEDAASP

SEQ ID NO: 14046 - protein, 14 aa, Mus sp.
TPYGAYNGPVPGYQ

SEQ ID NO: 14047 - protein, 14 aa, Mus sp.
TKWFSAPLLLEASE

SEQ ID NO: 14048 - protein, 17 aa, Mus sp.
ETDSVVSSVTTKAKGVA

SEQ ID NO: 14049 - protein, 16 aa, Mus sp.
GGLPDYSAPNPIKVTH

SEQ ID NO: 14050 - protein, 13 aa, Mus sp.
YTIPFYTPIPNGL

SEQ ID NO: 14051 - protein, 14 aa, Mus sp.
GDIEHPRAIALDPR

SEQ ID NO: 14052 - protein, 12 aa, Mus sp.
FSYAFPKAVSVF

SEQ ID NO: 14053 - protein, 18 aa, Mus sp.
SIPEAQWQSSLARTSSAE

SEQ ID NO: 14054 - protein, 17 aa, Mus sp.
IGFRYVHPLTEEAIEEM

SEQ ID NO: 14055 - protein, 15 aa, Mus sp.
GYPTAYPAAAPAYNP

SEQ ID NO: 14056 - protein, 17 aa, Mus sp.
SEDNVYHSSNAVYRAPS

SEQ ID NO: 14057 - protein, 15 aa, Mus sp.
FFWNVAPGAESAVAS

SEQ ID NO: 14058 - protein, 21 aa, Mus sp.
EPSKLKRSYSSPDITQALQEE

SEQ ID NO: 14059 - protein, 16 aa, Mus sp.
IQRVQAMKSPDHNGED

SEQ ID NO: 14060 - protein, 20 aa, Mus sp.
GPEAPLDELVGAYPNYNEEE

SEQ ID NO: 14061 - protein, 17 aa, Mus sp.
KPVPAAPVPSPVAPAPV

SEQ ID NO: 14062 - protein, 34 aa, Mus sp.; identical to SEQ ID NO: 1398

SEQ ID NO: 14063 - protein, 15 aa, Mus sp.
YVPWNFHEPQPGQYE

SEQ ID NO: 14064 - protein, 18 aa, Mus sp.
EDPDGFSWPATLPSVYKQ

SEQ ID NO: 14065 - protein, 29 aa, Mus sp.
AVGKVIPELNGKLTGMAFRVPTPNVSVVD

SEQ ID NO: 14066 - protein, 22 aa, Mus sp.
KHVPSGIVVKVETGGEPRSAAT

SEQ ID NO: 14067 - protein, 18 aa, Mus sp.
ITIGNERFRCPEAIFQPS

SEQ ID NO: 14068 - protein, 17 aa, Mus sp.
KPTVTVVSPLPNDSINP

SEQ ID NO: 14069 - protein, 16 aa, Mus sp.
TVIHFNNPKVQASLSA

SEQ ID NO: 14070 - protein, 18 aa, Mus sp.
FPKTNATSPGVNSSASPQ

SEQ ID NO: 14071 - protein, 12 aa, Mus sp.
NSEFDPPGPNVA

SEQ ID NO: 14072 - protein, 17 aa, Mus sp.
LPNVQVEGPTPNRPRKQ

SEQ ID NO: 14073 - protein, 14 aa, Mus sp.
GIFKGPTAENAEYL

SEQ ID NO: 14074 - protein, 13 aa, Mus sp.
PPSYYTQPVPVPN

SEQ ID NO: 14075 - protein, 13 aa, Mus sp.
LDWQYPGSRGSPP

SEQ ID NO: 14076 - protein, 14 aa, Mus sp.
DTIEFRGPNGLLVY

SEQ ID NO: 14077 - protein, 24 aa, Mus sp.
EAQKSSSIASFKDPKISTSLPVLD

SEQ ID NO: 14078 - protein, 16 aa, Mus sp.
SLKYHFVTPLTSMVVT

SEQ ID NO: 14079 - protein, 14 aa, Mus sp.
LEDFYGSPIPSVSL

SEQ ID NO: 14080 - protein, 18 aa, Mus sp.
FHKAFLEVNEEGSEAAAS

SEQ ID NO: 14081 - protein, 14 aa, Mus sp.
GVELYRAPFPLYAL

SEQ ID NO: 14082 - protein, 14 aa, Mus sp.
EDVTFIGPDTHAIQ

SEQ ID NO: 14083 - protein, 15 aa, Mus sp.
MFETFNTPAMYVAIQ

SEQ ID NO: 14084 - protein, 18 aa, Mus sp.
TKKFRFEEPVVLPDLSDQ

SEQ ID NO: 14085 - protein, 16 aa, Mus sp.
DFDEEYFSSTSELAKD

SEQ ID NO: 14086 - protein, 17 aa, Mus sp.
TPQSPTYTPSSPSYSPS

SEQ ID NO: 14087 - protein, 18 aa, Mus sp.
GGDTHFDSAEPWTVQNED

SEQ ID NO: 14088 - protein, 15 aa, Mus sp.
INDYKGAVIVVSHDA

SEQ ID NO: 14089 - protein, 17 aa, Mus sp.
YPNTPYISPVASYSGQP

SEQ ID NO: 14090 - protein, 24 aa, Mus sp.
TPSPESPDQWSSSSPHSNISDWSE

SEQ ID NO: 14091 - protein, 13 aa, Mus sp.
DLWGPGARVAADS

SEQ ID NO: 14092 - protein, 15 aa, Mus sp.
RPHWLEPTIYSSEED

SEQ ID NO: 14093 - protein, 14 aa, Mus sp.
VADKEFHAPLIIDE

SEQ ID NO: 14094 - protein, 15 aa, Mus sp.
DIRWQQPSPSPTGPY

SEQ ID NO: 14095 - protein, 9 aa, Mus sp.
QILSDFPKL

SEQ ID NO: 14096 - protein, 16 aa, Mus sp.
TSSLAAPTVEAAASAP

SEQ ID NO: 14097 - protein, 16 aa, Mus sp.
QSTDYGNFLANEASPL

SEQ ID NO: 14098 - protein, 13 aa, Mus sp.
EVWERPLSNLAWA

SEQ ID NO: 14099 - protein, 17 aa, Mus sp.
SHPQYAEPGAEAAFSGR

SEQ ID NO: 14100 - protein, 10 aa, Mus sp.
LSYIGPSVNK

SEQ ID NO: 14101 - protein, 19 aa, Mus sp.
LPTELSNTYTFPNPAHPPG

SEQ ID NO: 14102 - protein, 18 aa, Mus sp.
ITDKFWGPSGAESVIGGV

SEQ ID NO: 14103 - protein, 11 aa, Mus sp.
EGYALPHAILR

SEQ ID NO: 14104 - protein, 16 aa, Mus sp.
EEKYTVIYPYTARDQD

SEQ ID NO: 14105 - protein, 14 aa, Mus sp.
RRYNPPIIHQGFQD

SEQ ID NO: 14106 - protein, 17 aa, Mus sp.
NNIPYFETSAKEAINVE

SEQ ID NO: 14107 - protein, 16 aa, Mus sp.
YDKYFTNPQISQGVPG

SEQ ID NO: 14108 - protein, 15 aa, Mus sp.
YENVQVSPVPGGPPG

SEQ ID NO: 14109 - protein, 16 aa, Mus sp.
QPVVIYSSPGVILPKQ

SEQ ID NO: 14110 - protein, 18 aa, Mus sp.
NPWGEVEWKGPWSDSSYE

SEQ ID NO: 14111 - protein, 17 aa, Mus sp.
GGKDFNMPLTISSLKDG

SEQ ID NO: 14112 - protein, 13 aa, Mus sp.
EEEKAPEVSPAQP

SEQ ID NO: 14113 - protein, 20 aa, Mus sp.
EQRATFHTPEAPPNLAPAPP

SEQ ID NO: 14114 - protein, 17 aa, Mus sp.
VEPYEVHNPVPLIVGSS

SEQ ID NO: 14115 - protein, 15 aa, Mus sp.
EEAFHPREMKAEDED

SEQ ID NO: 14116 - protein, 20 aa, Mus sp.
DGDLERFLSSAAAVSKEHPV

SEQ ID NO: 14117 - protein, 15 aa, Mus sp.
AVDALASSHPLSSPA

SEQ ID NO: 14118 - protein, 16 aa, Mus sp.
KFIYVDVLPEEAVGPV

SEQ ID NO: 14119 - protein, 16 aa, Mus sp.
TIFQHHFPAAIDSFQD

SEQ ID NO: 14120 - protein, 18 aa, Mus sp.
ELGRPDAEYWNSQPEILE

SEQ ID NO: 14121 - protein, 20 aa, Mus sp.
DKSYIEGYVPSQADVAVFEA

SEQ ID NO: 14122 - protein, 12 aa, Mus sp.
EQEVLAPQVVLS

SEQ ID NO: 14123 - protein, 15 aa, Mus sp.
SQGNLIPARPAPAPP

SEQ ID NO: 14124 - protein, 15 aa, Mus sp.
TPERLNSPVTIPAVM

SEQ ID NO: 14125 - protein, 13 aa, Mus sp.
LRDWESPYSHDLD

SEQ ID NO: 14126 - protein, 17 aa, Mus sp.
HGLELEEPPLVLAAANV

SEQ ID NO: 14127 - protein, 13 aa, Mus sp.
AVDVFFPPEAQND

SEQ ID NO: 14128 - protein, 13 aa, Mus sp.
RKIVYEGPELNHA

SEQ ID NO: 14129 - protein, 13 aa, Mus sp.
RYMAPEVLDEHIR

SEQ ID NO: 14130 - protein, 13 aa, Mus sp.
DYVPPTANLDQKD

SEQ ID NO: 14131 - protein, 16 aa, Mus sp.
REGSYEAAKILLDHFA

SEQ ID NO: 14132 - protein, 17 aa, Mus sp.
YAVDIRSPAISWVNNLE

SEQ ID NO: 14133 - protein, 18 aa, Mus sp.
FPLKEDNWSLPNRAVEPQ

SEQ ID NO: 14134 - protein, 16 aa, Mus sp.
SPDVVYSPETIEARYE

SEQ ID NO: 14135 - protein, 14 aa, Mus sp.
TTSSYSNPTIGYEN

SEQ ID NO: 14136 - protein, 13 aa, Mus sp.
QREEYQPATPGLG

SEQ ID NO: 14137 - protein, 12 aa, Mus sp.
LKYHFVTPLTSM

SEQ ID NO: 14138 - protein, 14 aa, Mus sp.
KPTVTVVSPLPNDS

SEQ ID NO: 14139 - protein, 17 aa, Mus sp.
FADDTYTESYISTIGVD

SEQ ID NO: 14140 - protein, 18 aa, Mus sp.
GDLSWHPALTTKSKMRDP

SEQ ID NO: 14141 - protein, 14 aa, Mus sp.
KLISFSPTVNTSVS

SEQ ID NO: 14142 - protein, 14 aa, Mus sp.
LRDWESPYSHDLDT

SEQ ID NO: 14143 - protein, 15 aa, Mus sp.
INPDNVATPIAASLG

SEQ ID NO: 14144 - protein, 16 aa, Mus sp.
LPYVQYFGGVSALSKQ

SEQ ID NO: 14145 - protein, 14 aa, Mus sp.
HPIQWNAPEPSHIT

SEQ ID NO: 14146 - protein, 14 aa, Mus sp.
GTPEFLAPEVLTDT

SEQ ID NO: 14147 - protein, 14 aa, Mus sp.
EEIEVAPPKAHEVR

SEQ ID NO: 14148 - protein, 20 aa, Listeria monocytogenes
VWTKPNKIEGAQKISALSTY

SEQ ID NO: 14149 - protein, 17 aa, Mus sp.
LDDNVFVPPESLQEEDE

SEQ ID NO: 14150 - protein, 16 aa, Mus sp.
VLPANAFASPLQNPDN

SEQ ID NO: 14151 - protein, 16 aa, Mus sp.
VLEMYKVHNPVPLIVG

SEQ ID NO: 14152 - protein, 18 aa, Mus sp.
DFYPFDGPSGLLAHAFPP

SEQ ID NO: 14153 - protein, 17 aa, Mus sp.
DLPNSFDGPVTITIVNR

SEQ ID NO: 14154 - protein, 14 aa, Mus sp.
FDYSGSQAIKALKE

SEQ ID NO: 14155 - protein, 18 aa, Mus sp.
VIEDRDHYIPNTLNPVFG

SEQ ID NO: 14156 - protein, 20 aa, Mus sp.
SPTSPSYSPTSPNYSPTSPN

SEQ ID NO: 14157 - protein, 17 aa, Mus sp.
FPLKEDNWSLPNRAVEP

SEQ ID NO: 14158 - protein, 16 aa, Mus sp.
LKRSYSSPDITQALQE

SEQ ID NO: 14159 - protein, 15 aa, Mus sp.
YPNFAGPQAALANKS

SEQ ID NO: 14160 - protein, 19 aa, Mus sp.
NPTDAYLDAMMNEAPGPIN

SEQ ID NO: 14161 - protein, 15 aa, Mus sp.
LKDREQHMFKISALE

SEQ ID NO: 14162 - protein, 14 aa, Mus sp.
DKEFHAPLIIDENG

SEQ ID NO: 14163 - protein, 14 aa, Mus sp.
VRVSYYGPKTSPVQ

SEQ ID NO: 14164 - protein, 19 aa, Mus sp.
DSRTNTAYVGSAILSEETA

SEQ ID NO: 14165 - protein, 17 aa, Mus sp.
REQFSYVLPTVHSLEPS

SEQ ID NO: 14166 - protein, 17 aa, Mus sp.
DYVELPPSVSQAATSPP

SEQ ID NO: 14167 - protein, 16 aa, Mus sp.
VDFDFAGPAIHGSAVF

SEQ ID NO: 14168 - protein, 12 aa, Mus sp.
TPEYLAPEIILS

SEQ ID NO: 14169 - protein, 16 aa, Mus sp.
DLVDAVTPSPQPSKEE

SEQ ID NO: 14170 - protein, 17 aa, Mus sp.
AAPHIYQNSFVQVVLNS

SEQ ID NO: 14171 - protein, 16 aa, Mus sp.
FINIYSASSVSEVNDG

SEQ ID NO: 14172 - protein, 15 aa, Mus sp.
LKRSYSSPDITQALQ

SEQ ID NO: 14173 - protein, 17 aa, Mus sp.
RVKQYYEVPIAMKSVFD

SEQ ID NO: 14174 - protein, 16 aa, Mus sp.
NPTDEYLDAMMNEAPG

SEQ ID NO: 14175 - protein, 15 aa, Mus sp.
KFVYAGSNSGVVQAP

SEQ ID NO: 14176 - protein, 16 aa, Mus sp.
AQTAYSANPASQAFVL

SEQ ID NO: 14177 - protein, 14 aa, Mus sp.
SPHPYQLPQALAPH

SEQ ID NO: 14178 - protein, 22 aa, Mus sp.
VPPAGGGDPEAPAPAPAAERPP

SEQ ID NO: 14179 - protein, 19 aa, Mus sp.
DPEDHTVSFVQPNGAIFEP

SEQ ID NO: 14180 - protein, 13 aa, Mus sp.
ITDKFWGPSGAES

SEQ ID NO: 14181 - protein, 14 aa, Mus sp.
LRDNYRFAHTNIES

SEQ ID NO: 14182 - protein, 13 aa, Mus sp.
KFVYAGSNSGVVQ

SEQ ID NO: 14183 - protein, 16 aa, Mus sp.
HADASFVAAIPSTQVV

SEQ ID NO: 14184 - protein, 14 aa, Mus sp.
EQEVLAPQVVLSLG

SEQ ID NO: 14185 - protein, 16 aa, Mus sp.
IRSDWTNPEINKAVLH

SEQ ID NO: 14186 - protein, 14 aa, Mus sp.
EDFYGSPIPSVSLK

SEQ ID NO: 14187 - protein, 15 aa, Mus sp.
GIHHWTPPKGHVDPG

SEQ ID NO: 14188 - protein, 16 aa, Mus sp.
QLEALVGPEANVGPYG

SEQ ID NO: 14189 - protein, 19 aa, Mus sp.
RPPGPPPAPQPPSPAPSPP

SEQ ID NO: 14190 - protein, 14 aa, Mus sp.
FPDNYNSPTPYKIQ

SEQ ID NO: 14191 - protein, 16 aa, Mus sp.
FPGQPGAPGAYPSAPG

SEQ ID NO: 14192 - protein, 15 aa, Mus sp.
GDISISGPKVNVEAP

SEQ ID NO: 14193 - protein, 19 aa, Mus sp.
APISSHTAPRPNPTPALPQ

SEQ ID NO: 14194 - protein, 17 aa, Mus sp.
GIYEYYEPRLSVLPSPV

SEQ ID NO: 14195 - protein, 14 aa, Mus sp.
LPAAAQAPDALPAG

SEQ ID NO: 14196 - protein, 13 aa, Mus sp.
LIEVSSPITLQAL

SEQ ID NO: 14197 - protein, 30 aa, Mus sp.; identical to SEQ ID NO: 1359

SEQ ID NO: 14198 - protein, 15 aa, Mus sp.
SIASFKDPKISTSLP

SEQ ID NO: 14199 - protein, 16 aa, Mus sp.
KFRFEEPVVLPDLSDQ

SEQ ID NO: 14200 - protein, 10 aa, BOVIN
VVPPFLQPEV

SEQ ID NO: 14201 - protein, 19 aa, Mus sp.
SPPPGGYGQPSVLPGGYPA

SEQ ID NO: 14202 - protein, 12 aa, Mus sp.
EDFYGSPIPSVS

SEQ ID NO: 14203 - protein, 23 aa, Mus sp.
KPSEGEEEAASAGGPQVNPMPVT

SEQ ID NO: 14204 - protein, 18 aa, Mus sp.
APVEGASPTSISAVDGLT

SEQ ID NO: 14205 - protein, 20 aa, Mus sp.
SPTSPNYTPTSPNYSPTSPS

SEQ ID NO: 14206 - protein, 21 aa, Mus sp.
WGIDPYDQPNAIYIERHEPFG

SEQ ID NO: 14207 - protein, 13 aa, Mus sp.
YYRGAQAAIVVYD

SEQ ID NO: 14208 - protein, 15 aa, Mus sp.
LRLQVESPQVHWEPT

SEQ ID NO: 14209 - protein, 16 aa, Mus sp.
MDLDIFNLPNVEISKD

SEQ ID NO: 14210 - protein, 17 aa, Mus sp.
LPPHVYSTPQPSLPPVQ

SEQ ID NO: 14211 - protein, 13 aa, Mus sp.
TGMAFRVPTPNVS

SEQ ID NO: 14212 - protein, 15 aa, Mus sp.
LPNSFDGPVTITIVN

SEQ ID NO: 14213 - protein, 15 aa, Mus sp.
SPNYAAPEVISGRLY

SEQ ID NO: 14214 - protein, 14 aa, Mus sp.
RKIVYEGPELNHAF

SEQ ID NO: 14215 - protein, 23 aa, Mus sp.
KPTVTVVSPLPNDSINPQPSPDG

SEQ ID NO: 14216 - protein, 16 aa, Mus sp.
VPTVPLLPPQVNQSLA

SEQ ID NO: 14217 - protein, 16 aa, Mus sp.
SLLYNVPAVAEEIQDE

SEQ ID NO: 14218 - protein, 21 aa, Mus sp.
IKVPDVDISSPGINVEAPDIH

SEQ ID NO: 14219 - protein, 13 aa, Mus sp.
VNSQYQEPDIIIH

SEQ ID NO: 14220 - protein, 14 aa, Mus sp.
GDLSWHPALTTKSK

SEQ ID NO: 14221 - protein, 19 aa, Mus sp.
DERFGVRFPAMSDAYDRDM

SEQ ID NO: 14222 - protein, 14 aa, Mus sp.
DYLKWLFPTSMRSN

SEQ ID NO: 14223 - protein, 16 aa, Mus sp.
RLDNYDAPDIANIAIS

SEQ ID NO: 14224 - protein, 17 aa, Mus sp.
DPTTAFQAPDVGQALLQ

SEQ ID NO: 14225 - protein, 15 aa, Mus sp.
DSSKNVFLSPMSISS

SEQ ID NO: 14226 - protein, 17 aa, Mus sp.
ETELDQLFSGPLPGRLP

SEQ ID NO: 14227 - protein, 13 aa, Mus sp.
MYKVHNPVPLIVG

SEQ ID NO: 14228 - protein, 19 aa, Mus sp.
DSVTTDHISPAGNIARNSP

SEQ ID NO: 14229 - protein, 15 aa, Mus sp.
TITVQGPKSSRSLPV

SEQ ID NO: 14230 - protein, 15 aa, Mus sp.
RNYEYYASHVPESVK

SEQ ID NO: 14231 - protein, 17 aa, Mus sp.
DVRAVAHSPTALISGGT

SEQ ID NO: 14232 - protein, 18 aa, Mus sp.
KPVPAAPVPSPVAPAPVP

SEQ ID NO: 14233 - protein, 16 aa, Mus sp.
HNKLYVLQWLTLFFDN

SEQ ID NO: 14234 - protein, 19 aa, Mus sp.
DGREVSSVEAPSVSPARHQ

SEQ ID NO: 14235 - protein, 21 aa, Mus sp.
SDEGERYIAPTVLVDVQETEP

SEQ ID NO: 14236 - protein, 16 aa, Mus sp.
DPSAFAAAAPAAAATT

SEQ ID NO: 14237 - protein, 17 aa, Mus sp.
VPDVDISSPGINVEAPD

SEQ ID NO: 14238 - protein, 17 aa, Mus sp.
SLLLHWQPPLSHNGVLT

SEQ ID NO: 14239 - protein, 22 aa, Mus sp.
RPDAEYWNSQPEILERTRAELD

SEQ ID NO: 14240 - protein, 16 aa, Mus sp.
FKHAVSDPSILDSLDL

SEQ ID NO: 14241 - protein, 16 aa, Mus sp.
VTEDNVFEAPTLVKVF

SEQ ID NO: 14242 - protein, 13 aa, Mus sp.
LDEFYSDPHAVAG

SEQ ID NO: 14243 - protein, 16 aa, Mus sp.
KYHFVTPLTSMVVTKP

SEQ ID NO: 14244 - protein, 13 aa, Mus sp.
IDYTVPTVIAEEM

SEQ ID NO: 14245 - protein, 14 aa, Mus sp.
SRGEYSWAVAQGVK

SEQ ID NO: 14246 - protein, 19 aa, Mus sp.
VPVPEFADSDPANIVHDFN

SEQ ID NO: 14247 - protein, 25 aa, Mus sp.
LSPDDADFVDVLHTFTRGSPGRSIG

SEQ ID NO: 14248 - protein, 13 aa, Mus sp.
KGPAFVNPLIPEN

SEQ ID NO: 14249 - protein, 13 aa, Mus sp.
SVFVAPAVTPVKG

SEQ ID NO: 14250 - protein, 16 aa, Mus sp.
FTAQWIAPSVQLTGYR

SEQ ID NO: 14251 - protein, 18 aa, Mus sp.
SILDRYYTPTISRERAVE

SEQ ID NO: 14252 - protein, 18 aa, Mus sp.
MPDMHFKAPKISMPDVDL

SEQ ID NO: 14253 - protein, 15 aa, Mus sp.
IASFKDPKISTSLPV

SEQ ID NO: 14254 - protein, 19 aa, Mus sp.
LAPMYYRGAQAAIVVYDIT

SEQ ID NO: 14255 - protein, 19 aa, Mus sp.
AGPNFEYAEAPSRLSPDDA

SEQ ID NO: 14256 - protein, 19 aa, Mus sp.
EDPDGFSWPATLPSVYKQP

SEQ ID NO: 14257 - protein, 16 aa, Mus sp.
LYPDTAGPEAALEAED

SEQ ID NO: 14258 - protein, 16 aa, Mus sp.
DDPIWRGPLPSNGVMH

SEQ ID NO: 14259 - protein, 17 aa, Mus sp.
NPKAEVARAQAALAVNI

SEQ ID NO: 14260 - protein, 21 aa, Mus sp.
FLYQQQGRLDKLTITSQNLQL

SEQ ID NO: 14261 - protein, 17 aa, Mus sp.
GRFTYQNAAAQPETGPG

SEQ ID NO: 14262 - protein, 16 aa, Mus sp.
GIPYFETSAANGTNIS

SEQ ID NO: 14263 - protein, 18 aa, Mus sp.
AGDAVAVAPAPAAAVEPA

SEQ ID NO: 14264 - protein, 20 aa, Mus sp.
FEDYVELPPSVSQAAKSPPG

SEQ ID NO: 14265 - protein, 19 aa, Mus sp.
MDEATRYLAPTILTDVDPN

SEQ ID NO: 14266 - protein, 18 aa, Mus sp.
VGTARYMAPEVLESRMNL

SEQ ID NO: 14267 - protein, 17 aa, Mus sp.
DSRTNTAYVGSAILSEE

SEQ ID NO: 14268 - protein, 16 aa, Mus sp.
APAAAEAPAAAEAPAA

SEQ ID NO: 14269 - protein, 14 aa, Mus sp.
GIDPYDQPNAIYIE

SEQ ID NO: 14270 - protein, 17 aa, Mus sp.
VHLWRYEGGYPALTEVM

SEQ ID NO: 14271 - protein, 15 aa, Mus sp.
VMDAYTSAVSLSATG

SEQ ID NO: 14272 - protein, 15 aa, Mus sp.
RSQVTPSVPSEALDD

SEQ ID NO: 14273 - protein, 18 aa, Mus sp.
VDKDQSIAPKTTRVTYPA

SEQ ID NO: 14274 - protein, 22 aa, Mus sp.
TPPPPPPNEISPPHAVEEEEDD

SEQ ID NO: 14275 - protein, 24 aa, Mus sp.
DSGDGVTHTVPIYEGYALPHAILR

SEQ ID NO: 14276 - protein, 16 aa, Mus sp.
ADDTYTESYISTIGVD

SEQ ID NO: 14277 - protein, 14 aa, Mus sp.
DASFVAAIPSTQVV

SEQ ID NO: 14278 - protein, 14 aa, Mus sp.
GNVYIHPTAKVAPS

SEQ ID NO: 14279 - protein, 15 aa, Mus sp.
LEMYKVHNPVPLIVG

SEQ ID NO: 14280 - protein, 14 aa, Mus sp.
IDIFARPTAGFITG

SEQ ID NO: 14281 - protein, 19 aa, Mus sp.
TPRVLSQAPSPLYSVEFSE

SEQ ID NO: 14282 - protein, 15 aa, Mus sp.
ADFHYAASKALRVPA

SEQ ID NO: 14283 - protein, 16 aa, Mus sp.
INKMDDPTVNWSNERY

SEQ ID NO: 14284 - protein, 8 aa, Mus sp.
ITGYFPSM

SEQ ID NO: 14285 - protein, 13 aa, Mus sp.
FPYVTPAPHEPVK

SEQ ID NO: 14286 - protein, 13 aa, Mus sp.
VGAWTGPMGNWAM

SEQ ID NO: 14287 - protein, 15 aa, Mus sp.
EEEYYAEPGVTEAEP

SEQ ID NO: 14288 - protein, 11 aa, Mus sp.
VATSIHEAVTK

SEQ ID NO: 14289 - protein, 16 aa, Mus sp.
TPEYLAPEVLEDNDYG

SEQ ID NO: 14290 - protein, 17 aa, Mus sp.
LVKDGYQMAQPVFAPKN

SEQ ID NO: 14291 - protein, 16 aa, Mus sp.
FADDYTTANARKLIDE

SEQ ID NO: 14292 - protein, 14 aa, Mus sp.
NELDYYDSPSVNAR

SEQ ID NO: 14293 - protein, 14 aa, Mus sp.
KQEYDESGPSIVHR

SEQ ID NO: 14294 - protein, 16 aa, Mus sp.
DGIHHWTPPKGHVDPG

SEQ ID NO: 14295 - protein, 18 aa, Mus sp.
FHQRFESPDSQASAEQPE

SEQ ID NO: 14296 - protein, 11 aa, Mus sp.
FVAPAVTPVKG

SEQ ID NO: 14297 - protein, 14 aa, Mus sp.
QIDYTVPTVIAEEM

SEQ ID NO: 14298 - protein, 17 aa, Mus sp.
DINAFVGAVSLTAADSN

SEQ ID NO: 14299 - protein, 16 aa, Mus sp.
LPENFRRPQTDQAVEF

SEQ ID NO: 14300 - protein, 19 aa, Mus sp.
EPTSSSPYNPPDLEEAAKT

SEQ ID NO: 14301 - protein, 16 aa, Mus sp.
ISKQEYDESGPSIVHR

SEQ ID NO: 14302 - protein, 13 aa, Mus sp.
VIHFNNPKVQASL

SEQ ID NO: 14303 - protein, 19 aa, Mus sp.
APQGSLGEYLFERLTLKHD

SEQ ID NO: 14304 - protein, 17 aa, Mus sp.
KILDMFVNPTSSLAYFN

SEQ ID NO: 14305 - protein, 17 aa, Mus sp.
EATRYLAPTILTDVDPN

SEQ ID NO: 14306 - protein, 15 aa, Mus sp.
KFTLQDSRTNTAYVG

SEQ ID NO: 14307 - protein, 16 aa, Mus sp.
HFPDYRAAEVRETLNQ

SEQ ID NO: 14308 - protein, 19 aa, Mus sp.
IARQNFTEPTAIQAQGWPV

SEQ ID NO: 14309 - protein, 23 aa, Mus sp.
PGIDGIPGEKGNAGDIGGPGPPG

SEQ ID NO: 14310 - protein, 15 aa, Mus sp.
GSDIFAAPAPQSTAT

SEQ ID NO: 14311 - protein, 19 aa, Mus sp.
VNGKKFTAPHILIATGGVP

SEQ ID NO: 14312 - protein, 17 aa, Mus sp.
QPYSHSTAPSALPALDS

SEQ ID NO: 14313 - protein, 21 aa, Mus sp.
ITFPLKQQRHTAAPTDPTDGP

SEQ ID NO: 14314 - protein, 21 aa, Mus sp.
EKIQASVATNPIITPVAQENQ

SEQ ID NO: 14315 - protein, 15 aa, Mus sp.
ELDQLFSGPLPGRLP

SEQ ID NO: 14316 - protein, 18 aa, Mus sp.
ADRFMDDIACMIGYRPCP

SEQ ID NO: 14317 - protein, 16 aa, Mus sp.
VQAFTHAPAALEADRG

SEQ ID NO: 14318 - protein, 16 aa, Mus sp.
KGVKYEAPQTTDGLAG

SEQ ID NO: 14319 - protein, 13 aa, Mus sp.
RRYNPPIIHQGFQ

SEQ ID NO: 14320 - protein, 14 aa, Mus sp.
DGDSYRSPWSNKYD

SEQ ID NO: 14321 - protein, 14 aa, Mus sp.
SQPLLLGIACNETS

SEQ ID NO: 14322 - protein, 16 aa, Mus sp.
WKQKYEETHAELEASQ

SEQ ID NO: 14323 - protein, 30 aa, Mus sp.; identical to SEQ ID NO: 3000

SEQ ID NO: 14324 - protein, 17 aa, Mus sp.
THDLDFRAPHVLVLGSG

SEQ ID NO: 14325 - protein, 13 aa, Mus sp.
FKVLAPQISFGLD

SEQ ID NO: 14326 - protein, 20 aa, Mus sp.
NGKLTGMAFRVPTPNVSVVD

SEQ ID NO: 14327 - protein, 16 aa, Mus sp.
SVYTRYHCSLPVPEPS

SEQ ID NO: 14328 - protein, 15 aa, Mus sp.
ISNYGFPRSVQAIDA

SEQ ID NO: 14329 - protein, 15 aa, Mus sp.
LDNYDAPDIANIAIS

SEQ ID NO: 14330 - protein, 15 aa, Mus sp.
ASVATNPIITPVAQE

SEQ ID NO: 14331 - protein, 17 aa, Mus sp.
GDTIEFRGPNGLLVYQG

SEQ ID NO: 14332 - protein, 16 aa, Mus sp.
AAPASAPTPSTPAPTP

SEQ ID NO: 14333 - protein, 15 aa, Mus sp.
NFPLKPGIPLPSPED

SEQ ID NO: 14334 - protein, 17 aa, Mus sp.
ELDQLFSGPLPGRLPVN

SEQ ID NO: 14335 - protein, 14 aa, Mus sp.
YEGYALPHAILRLD

SEQ ID NO: 14336 - protein, 12 aa, Mus sp.
FGPYYTEPVIAG

SEQ ID NO: 14337 - protein, 14 aa, Mus sp.
SEEEYSAPLPTPAP

SEQ ID NO: 14338 - protein, 17 aa, Mus sp.
RAKQIVWNGPVGVFEWE

SEQ ID NO: 14339 - protein, 18 aa, Mus sp.
TSQELVRAPTAALSPEPQ

SEQ ID NO: 14340 - protein, 13 aa, Mus sp.
WTYNPAAVSKVAP

SEQ ID NO: 14341 - protein, 15 aa, Mus sp.
GTPDYIAPEIIAYQP

SEQ ID NO: 14342 - protein, 15 aa, Mus sp.
YGYHVNSPQVWSEPS

SEQ ID NO: 14343 - protein, 15 aa, Mus sp.
KGPAFVNPLIPENKE

SEQ ID NO: 14344 - protein, 15 aa, Mus sp.
EDYVQSMDVAAFNKI

SEQ ID NO: 14345 - protein, 16 aa, Mus sp.
TQVQWNDPGAQYSLVN

SEQ ID NO: 14346 - protein, 17 aa, Mus sp.
LQKTQYISPNLNPNDVT

SEQ ID NO: 14347 - protein, 18 aa, Mus sp.
IVLQAAVPKSMKVKLQPP

SEQ ID NO: 14348 - protein, 15 aa, Mus sp.
ESKATYSTNSPVWEE

SEQ ID NO: 14349 - protein, 18 aa, Mus sp.
GPKPFSAPKPQTSPSPKP

SEQ ID NO: 14350 - protein, 17 aa, Mus sp.
GTSWTYNPAAVSKVAPA

SEQ ID NO: 14351 - protein, 15 aa, Mus sp.
RESKVVVPPLPGKAF

SEQ ID NO: 14352 - protein, 16 aa, Mus sp.
KNLDYVATSIHEAVTK

SEQ ID NO: 14353 - protein, 15 aa, Mus sp.
LEHSNDPSAIMAPFY

SEQ ID NO: 14354 - protein, 17 aa, Mus sp.
VPTDKYYGAQTVRSTMN

SEQ ID NO: 14355 - protein, 15 aa, Mus sp.
VDVFYSSGIPATARP

SEQ ID NO: 14356 - protein, 14 aa, Mus sp.
KSKYKASIAALEAK

SEQ ID NO: 14357 - protein, 18 aa, Mus sp.
TALTFSSPATNQAITIPV

SEQ ID NO: 14358 - protein, 16 aa, Mus sp.
RNRYWGTPIPLWVSED

SEQ ID NO: 14359 - protein, 20 aa, Mus sp.
KPVPAAPVPSPVAPAPVPSR

SEQ ID NO: 14360 - protein, 14 aa, Mus sp.
MAPYQGPDAAPGAL

SEQ ID NO: 14361 - protein, 15 aa, Mus sp.
SLLYNVPAVAEEIQD

SEQ ID NO: 14362 - protein, 11 aa, Mus sp.
FPYVTPAPHEP

SEQ ID NO: 14363 - protein, 17 aa, Mus sp.
DVPFTLAPHVLAAQGTI

SEQ ID NO: 14364 - protein, 14 aa, Mus sp.
DIYVWRGAQATLSN

SEQ ID NO: 14365 - protein, 18 aa, Mus sp.
EDRRYNPPIIHQGFQDTS

SEQ ID NO: 14366 - protein, 16 aa, Mus sp.
SPPPYAAYATPTPEVY

SEQ ID NO: 14367 - protein, 15 aa, Mus sp.
FDYSGSQAIKALKEE

SEQ ID NO: 14368 - protein, 17 aa, Mus sp.
APVEGASPTSISAVDGL

SEQ ID NO: 14369 - protein, 11 aa, Mus sp.
SVFVAPAVTPV

SEQ ID NO: 14370 - protein, 16 aa, Mus sp.
GPGAVEGPNPASSPDA

SEQ ID NO: 14371 - protein, 18 aa, Mus sp.
HNDLQYAAPGGLIGVGTK

SEQ ID NO: 14372 - protein, 16 aa, Mus sp.
TSWTYNPAAVSKVAPA

SEQ ID NO: 14373 - protein, 14 aa, Mus sp.
EPPPAYEPPAPAPA

SEQ ID NO: 14374 - protein, 17 aa, BOVIN
SVVVGPSVVAVPLPLHR

SEQ ID NO: 14375 - protein, 17 aa, Mus sp.
ISKQEYDESGPSIVHRK

SEQ ID NO: 14376 - protein, 16 aa, Mus sp.
IDPYDQPNAIYIERHE

SEQ ID NO: 14377 - protein, 15 aa, Mus sp.
LFEDNMALPSESVSS

SEQ ID NO: 14378 - protein, 17 aa, Mus sp.
EPKESVLPPKTSAAAQL

SEQ ID NO: 14379 - protein, 13 aa, Mus sp.
VHLRVFQPLPHEN

SEQ ID NO: 14380 - protein, 13 aa, Mus sp.
KFRFEEPVVLPDL

SEQ ID NO: 14381 - protein, 15 aa, Mus sp.
LPVKWTAPEALREKK

SEQ ID NO: 14382 - protein, 21 aa, Mus sp.
NGKLTGMAFRVPTPNVSVVDL

SEQ ID NO: 14383 - protein, 18 aa, Mus sp.
GKKFTAPHILIATGGVPT

SEQ ID NO: 14384 - protein, 18 aa, Mus sp.
RQPAWRDPLSPFAVGGDD

SEQ ID NO: 14385 - protein, 16 aa, Mus sp.
ASFKDPKISTSLPVLD

SEQ ID NO: 14386 - protein, 16 aa, Mus sp.
EEAGAYDGPRTADGIV

SEQ ID NO: 14387 - protein, 17 aa, Mus sp.
EIQPFHRAAAIQAISLD

SEQ ID NO: 14388 - protein, 13 aa, Mus sp.
GIPVYRFVLPANA

SEQ ID NO: 14389 - protein, 14 aa, Mus sp.
GQVYAFPSSQSVTE

SEQ ID NO: 14390 - protein, 13 aa, Mus sp.
RYMAPEVLDETIN

SEQ ID NO: 14391 - protein, 17 aa, Mus sp.
GPRAEEYEFLTPMEEAP

SEQ ID NO: 14392 - protein, 16 aa, Mus sp.
KADDIVGPVTHEIFEN

SEQ ID NO: 14393 - protein, 17 aa, Mus sp.
FKHAVSDPSILDSLDLN

SEQ ID NO: 14394 - protein, 16 aa, Mus sp.
GDNLVHAAIVAESAAI

SEQ ID NO: 14395 - protein, 13 aa, Mus sp.
DFVAWATGEPNFA

SEQ ID NO: 14396 - protein, 17 aa, Mus sp.
RFGPYYTEPVIAGLDPK

SEQ ID NO: 14397 - protein, 16 aa, Mus sp.
DVDFDFAGPAIHGSAV

SEQ ID NO: 14398 - protein, 22 aa, Mus sp.
GPNDERFGVRFPAMSDAYDRDM

SEQ ID NO: 14399 - protein, 18 aa, Mus sp.
GGGDPEAPAPAPAAERPP

SEQ ID NO: 14400 - protein, 17 aa, Mus sp.
NPPSYYTQPVPVPNANA

SEQ ID NO: 14401 - protein, 30 aa, Mus sp.; identical to SEQ ID NO: 2463

SEQ ID NO: 14402 - protein, 20 aa, Mus sp.
FPKPPSYNVATTLPSYDEAE

SEQ ID NO: 14403 - protein, 17 aa, Mus sp.
LEMYKVHNPVPLIVGSS

SEQ ID NO: 14404 - protein, 15 aa, Mus sp.
VNGKKFTAPHILIAT

SEQ ID NO: 14405 - protein, 15 aa, Mus sp.
KNNSFYGPEVKIEKG

SEQ ID NO: 14406 - protein, 12 aa, Mus sp.
GHKLGLGLEFQA

SEQ ID NO: 14407 - protein, 13 aa, Mus sp.
FRVPTPNVSVVDL

SEQ ID NO: 14408 - protein, 18 aa, Mus sp.
DGEEAGAYDGPRTADGIV

SEQ ID NO: 14409 - protein, 14 aa, Mus sp.
GAFTYYGVSALTAP

SEQ ID NO: 14410 - protein, 14 aa, Mus sp.
AGNFYVPAEPKLAF

SEQ ID NO: 14411 - protein, 13 aa, Mus sp.
IASFKDPKISTSL

SEQ ID NO: 14412 - protein, 14 aa, Mus sp.
GQDHVDFSQPEPHT

SEQ ID NO: 14413 - protein, 20 aa, Mus sp.
KNPTDEYLDAMMNEAPGPIN

SEQ ID NO: 14414 - protein, 11 aa, Mus sp.
HPIQWNAPEPS

SEQ ID NO: 14415 - protein, 18 aa, Mus sp.
IGRTWNDPSVQQDIKFLP

SEQ ID NO: 14416 - protein, 17 aa, Mus sp.
AGEEDWTISPVPQSIVD

SEQ ID NO: 14417 - protein, 17 aa, Mus sp.
EDNVFEAPTLVKVFKQP

SEQ ID NO: 14418 - protein, 16 aa, Mus sp.
GFQAYDFPAITTAQYS

SEQ ID NO: 14419 - protein, 16 aa, Mus sp.
GTPGYVAPEVLAQKPY

SEQ ID NO: 14420 - protein, 14 aa, Mus sp.
SDVIHAPLPSPVDK

SEQ ID NO: 14421 - protein, 18 aa, Mus sp.
GAEIEYAMAYSKAAFERE

SEQ ID NO: 14422 - protein, 27 aa, Mus sp.
APTPSTPAPTPAATPAASPAPVSSDPA

SEQ ID NO: 14423 - protein, 16 aa, Mus sp.
LDIYVWRGAQATLSNT

SEQ ID NO: 14424 - protein, 11 aa, Mus sp.
LSYIGPSVNKA

SEQ ID NO: 14425 - protein, 17 aa, Mus sp.
LGRPDAEYWNSQPEILE

SEQ ID NO: 14426 - protein, 19 aa, Mus sp.
NPTDEYLDAMMNEAPGPIN

SEQ ID NO: 14427 - protein, 15 aa, Mus sp.
IVDPYNNPVPRGLEA

SEQ ID NO: 14428 - protein, 19 aa, Mus sp.
MPNPKDNEVNHIRATCFNS

SEQ ID NO: 14429 - protein, 13 aa, Mus sp.
KPFQNPVPNQSPS

SEQ ID NO: 14430 - protein, 18 aa, Mus sp.
EPSPVSETVVTPEAAPEK

SEQ ID NO: 14431 - protein, 15 aa, Mus sp.
ITPDIIINPHAIPSR

SEQ ID NO: 14432 - protein, 28 aa, Mus sp.
EDDIEADHVGTYGISVYQSPGDIGQYTF

SEQ ID NO: 14433 - protein, 20 aa, Mus sp.
VTEDNVFEAPTLVKVFKQPS

SEQ ID NO: 14434 - protein, 13 aa, Mus sp.
SSIYYISSTIAYA

SEQ ID NO: 14435 - protein, 17 aa, Mus sp.
GHPGIIPPHATLVFDVE

SEQ ID NO: 14436 - protein, 16 aa, Mus sp.
EPYEVHNPVPLIVGSS

SEQ ID NO: 14437 - protein, 13 aa, Mus sp.
KWKYEKPDGSPVF

SEQ ID NO: 14438 - protein, 14 aa, Mus sp.
QEVLAPQVVLSLGG

SEQ ID NO: 14439 - protein, 20 aa, Mus sp.
SPESPDQWSSSSPHSASDWS

SEQ ID NO: 14440 - protein, 15 aa, Mus sp.
NLDWQYPGSRGSPPK

SEQ ID NO: 14441 - protein, 18 aa, Mus sp.
GRADFREPNAQVSRPIPD

SEQ ID NO: 14442 - protein, 13 aa, Mus sp.
YAVEKNPNAVVTL

SEQ ID NO: 14443 - protein, 27 aa, Mus sp.
DEPQGWDLVDAVTPSPQPSKEEDGPPA

SEQ ID NO: 14444 - protein, 20 aa, Mus sp.
LVTEDNVFEAPTLVKVFKQP

SEQ ID NO: 14445 - protein, 17 aa, Mus sp.
LKRSYSSPDITQALQEE

SEQ ID NO: 14446 - protein, 18 aa, Listeria monocytogenes
MNRVMLPLQQMGAKMHGK

SEQ ID NO: 14447 - protein, 15 aa, Mus sp.
ADPSAFAAAAPAAAA

SEQ ID NO: 14448 - protein, 17 aa, Mus sp.
GVPDDLLYSFPVVIKNK

SEQ ID NO: 14449 - protein, 17 aa, Mus sp.
NPDEAVAYGAAVQAAIL

SEQ ID NO: 14450 - protein, 19 aa, Mus sp.
KGQDHVDFSQPEPHTVLFH

SEQ ID NO: 14451 - protein, 15 aa, Mus sp.
RPVQFPYVTPAPHEP

SEQ ID NO: 14452 - protein, 33 aa, Mus sp.; identical to SEQ ID NO: 2080

SEQ ID NO: 14453 - protein, 20 aa, Mus sp.
HDGDSVVFAGPAGNSVETRG

SEQ ID NO: 14454 - protein, 15 aa, Mus sp.
INKMDDPTVNWSNER

SEQ ID NO: 14455 - protein, 15 aa, Mus sp.
LLYNVPAVAEEIQDE

SEQ ID NO: 14456 - protein, 14 aa, Mus sp.
VTRQTTQYPEANAL

SEQ ID NO: 14457 - protein, 12 aa, Mus sp.
RDYVPPTANLDQ

SEQ ID NO: 14458 - protein, 15 aa, Mus sp.
EGPRYLSSTAVVVAE

SEQ ID NO: 14459 - protein, 15 aa, Mus sp.
LALMYNTPRAATIIA

SEQ ID NO: 14460 - protein, 30 aa, Mus sp.; identical to SEQ ID NO: 2486

SEQ ID NO: 14461 - protein, 19 aa, Mus sp.
DAFKHAVSDPSILDSLDLN

SEQ ID NO: 14462 - protein, 19 aa, Mus sp.
RASLEDFYGSPIPSVSLKL

SEQ ID NO: 14463 - protein, 17 aa, Mus sp.
NLRDNYRFAHTNIESLV

SEQ ID NO: 14464 - protein, 22 aa, Mus sp.
DEDLETKKFRFEEPVVLPDLSD

SEQ ID NO: 14465 - protein, 19 aa, Mus sp.
EEVGEYRQPSGGSVPVSPG

SEQ ID NO: 14466 - protein, 19 aa, Mus sp.
LPKEELYMPPLVIKVIDHR

SEQ ID NO: 14467 - protein, 16 aa, Mus sp.
TEDNVFEAPTLVKVFK

SEQ ID NO: 14468 - protein, 15 aa, Mus sp.
GDQPVFEIPLSNVSQ

SEQ ID NO: 14469 - protein, 18 aa, Mus sp.
ITGVDFIGSTVGLAKVSA

SEQ ID NO: 14470 - protein, 13 aa, Mus sp.
DIFIGPKAEEHRG

SEQ ID NO: 14471 - protein, 17 aa, Mus sp.
DGELTYENVQVSPVPGG

SEQ ID NO: 14472 - protein, 17 aa, Mus sp.
LDKDSFSDPYAHVSFLH

SEQ ID NO: 14473 - protein, 15 aa, Mus sp.
GKPAQYIAVHVVPDQ

SEQ ID NO: 14474 - protein, 16 aa, Mus sp.
EGERYIAPTVLVDVQE

SEQ ID NO: 14475 - protein, 17 aa, Mus sp.
EPPPAYEPPAPAPAPLP

SEQ ID NO: 14476 - protein, 18 aa, Mus sp.
LPDSWASGYAVPVVTVVR

SEQ ID NO: 14477 - protein, 16 aa, Mus sp.
GSPAFQPPEIANGLDT

SEQ ID NO: 14478 - protein, 14 aa, Mus sp.
RQTTQYPEANALVR

SEQ ID NO: 14479 - protein, 15 aa, Mus sp.
APFDWEGAQASQALL

SEQ ID NO: 14480 - protein, 16 aa, Mus sp.
GPGDGYGYPRAQHVLS

SEQ ID NO: 14481 - protein, 23 aa, Listeria monocytogenes
VETKADIDALSLLSDKIFVTNQT

SEQ ID NO: 14482 - protein, 15 aa, Mus sp.
TPYSTPQMSPATTPA

SEQ ID NO: 14483 - protein, 14 aa, Mus sp.
VDLPNYSSPNALVL

SEQ ID NO: 14484 - protein, 15 aa, Mus sp.
LGVAYEAPSLATGYG

SEQ ID NO: 14485 - protein, 15 aa, Mus sp.
DVDFDFAGPAIHGSA

SEQ ID NO: 14486 - protein, 18 aa, Mus sp.
GTTVYRQFWIFDVQNPDD

SEQ ID NO: 14487 - protein, 16 aa, Mus sp.
GTPEYLAPEVLEDNDY

SEQ ID NO: 14488 - protein, 23 aa, Mus sp.
GPDGKGMNPPSYYTQPVPVPNAN

SEQ ID NO: 14489 - protein, 12 aa, Mus sp.
MYLSPLQQAVSD

SEQ ID NO: 14490 - protein, 12 aa, Mus sp.
LVYTSPVIPELK

SEQ ID NO: 14491 - protein, 12 aa, Mus sp.
TDYNSPEAGNIF

SEQ ID NO: 14492 - protein, 16 aa, Mus sp.
LKPVWYSPKVFIEGAD

SEQ ID NO: 14493 - protein, 12 aa, Mus sp.
TPFWMAPEVIQE

SEQ ID NO: 14494 - protein, 10 aa, Mus sp.
FVAPAVTPVK

SEQ ID NO: 14495 - protein, 15 aa, Mus sp.
FQFGYNTGVINAPET

SEQ ID NO: 14496 - protein, 19 aa, Mus sp.
DGTVPFWAHAGNAIPSADQ

SEQ ID NO: 14497 - protein, 19 aa, Mus sp.
NPQMPQYTSPQPGSALSPR

SEQ ID NO: 14498 - protein, 18 aa, Mus sp.
TPVFVHAGPFANIAHGNS

SEQ ID NO: 14499 - protein, 13 aa, Mus sp.
IVKYNASLVTPEM

SEQ ID NO: 14500 - protein, 18 aa, Mus sp.
EETAFQTPKPSQTPSVPP

SEQ ID NO: 14501 - protein, 19 aa, Mus sp.
APSNYLNNPYVRKALHIPE

SEQ ID NO: 14502 - protein, 15 aa, Mus sp.
ETVVTPEAAPEKNPV

SEQ ID NO: 14503 - protein, 15 aa, Mus sp.
SSEVYTFPVPERHLE

SEQ ID NO: 14504 - protein, 15 aa, Mus sp.
RAAFYHQPWAQEAVG

SEQ ID NO: 14505 - protein, 19 aa, Listeria monocytogenes
TVRAKSKTYPVYINEFALE

SEQ ID NO: 14506 - protein, 13 aa, Mus sp.
GSPNYAAPEVISG

SEQ ID NO: 14507 - protein, 17 aa, Mus sp.
VEYHFLSPYVSPRESPF

SEQ ID NO: 14508 - protein, 16 aa, Mus sp.
KGPAFVNPLIPENKEE

SEQ ID NO: 14509 - protein, 13 aa, Mus sp.
KSKYKASIAALEA

SEQ ID NO: 14510 - protein, 16 aa, Mus sp.
LTLPDFHVPEITIPEF

SEQ ID NO: 14511 - protein, 16 aa, Mus sp.
RATTYIDPRTGKSALD

SEQ ID NO: 14512 - protein, 13 aa, Mus sp.
APFDWEGAQASQA

SEQ ID NO: 14513 - protein, 16 aa, Mus sp.
SKTVYEGPFASRSLSD

SEQ ID NO: 14514 - protein, 18 aa, Mus sp.
ITSSYYRGAHGIIVVYDV

SEQ ID NO: 14515 - protein, 24 aa, Mus sp.
IPELNGKLTGMAFRVPTPNVSVVD

SEQ ID NO: 14516 - protein, 17 aa, Mus sp.
QPGLNGAAAAAAAEAPD

SEQ ID NO: 14517 - protein, 17 aa, Mus sp.
GRPDAEYWNSQPEILER

SEQ ID NO: 14518 - protein, 17 aa, Mus sp.
VDLPNYSSPNALVLNTK

SEQ ID NO: 14519 - protein, 17 aa, Mus sp.
LTTSSYSNPTIGYENRV

SEQ ID NO: 14520 - protein, 23 aa, Mus sp.
DEDLETKKFRFEEPVVLPDLSDQ

SEQ ID NO: 14521 - protein, 22 aa, Listeria monocytogenes
VMASDYTRGLSIRAIELVFENL

SEQ ID NO: 14522 - protein, 15 aa, Mus sp.
TSSYYRGAHGIIVVY

SEQ ID NO: 14523 - protein, 14 aa, Mus sp.
AYSSNQTHNLNPLL

SEQ ID NO: 14524 - protein, 17 aa, Mus sp.
DRKIVYEGPELNHAFGL

SEQ ID NO: 14525 - protein, 13 aa, Mus sp.
TPWKAPIVWEGTY

SEQ ID NO: 14526 - protein, 16 aa, Mus sp.
IEHLYKNPQAHIEGNM

SEQ ID NO: 14527 - protein, 21 aa, Mus sp.
RPHDTSLVSWVGSEPMPEAGL

SEQ ID NO: 14528 - protein, 13 aa, Mus sp.
VEGYEGSAASIST

SEQ ID NO: 14529 - protein, 16 aa, Mus sp.
KVEPYEVHNPVPLIVG

SEQ ID NO: 14530 - protein, 14 aa, Mus sp.
LEALVGPEANVGPY

SEQ ID NO: 14531 - protein, 13 aa, Mus sp.
NDLQYAAPGGLIG

SEQ ID NO: 14532 - protein, 15 aa, Mus sp.
SVFVAPAVTPVKGVL

SEQ ID NO: 14533 - protein, 19 aa, Mus sp.
DYLNSDGSAKSSCVSKDVP

SEQ ID NO: 14534 - protein, 16 aa, Mus sp.
WKALYTDPKSSETAAF

SEQ ID NO: 14535 - protein, 16 aa, Mus sp.
LPHFLHASPDVSEPIE

SEQ ID NO: 14536 - protein, 13 aa, Mus sp.
SIVYWMTSQPSDA

SEQ ID NO: 14537 - protein, 17 aa, Mus sp.
KGQDHVDFSQPEPHTVL

SEQ ID NO: 14538 - protein, 15 aa, Mus sp.
KRLEFEASQVLGTMD

SEQ ID NO: 14539 - protein, 17 aa, Mus sp.
SADDFFQGTKAALAGGT

SEQ ID NO: 14540 - protein, 14 aa, Mus sp.
QLEALVGPEANVGP

SEQ ID NO: 14541 - protein, 17 aa, Mus sp.
EEAGAYDGPRTADGIVS

SEQ ID NO: 14542 - protein, 17 aa, Mus sp.
LSSEMNTSTVNSAREEL

SEQ ID NO: 14543 - protein, 16 aa, Mus sp.
EELYMPPLVIKVIDHR

SEQ ID NO: 14544 - protein, 14 aa, Mus sp.
VEYHFLSPYVSPRE

SEQ ID NO: 14545 - protein, 17 aa, Mus sp.
TVKSFVGPTPAPAPAPR

SEQ ID NO: 14546 - protein, 15 aa, Mus sp.
EEVEHWFYPQENIID

SEQ ID NO: 14547 - protein, 15 aa, Listeria monocytogenes
YMEKHSVSRLVGAPP

SEQ ID NO: 14548 - protein, 16 aa, Mus sp.
LPSTSYLPSTPSVVPA

SEQ ID NO: 14549 - protein, 17 aa, Mus sp.
LNLAYIGAVPHSGIEQV

SEQ ID NO: 14550 - protein, 17 aa, Mus sp.
KTPESFLGPNAALVDLD

SEQ ID NO: 14551 - protein, 17 aa, Mus sp.
RTDWEAPTGQPSAPGPR

SEQ ID NO: 14552 - protein, 15 aa, Mus sp.
ADASFVAAIPSTQVV

SEQ ID NO: 14553 - protein, 19 aa, Mus sp.
VDGDVVHGFYNPAVSRIVE

SEQ ID NO: 14554 - protein, 14 aa, Mus sp.
ELVRAPTAALSPEP

SEQ ID NO: 14555 - protein, 15 aa, Mus sp.
GDTHFDSAEPWTVQN

SEQ ID NO: 14556 - protein, 12 aa, Mus sp.
NPIITPVAQENQ

SEQ ID NO: 14557 - protein, 17 aa, Mus sp.
GGDTHFDSAEPWTVQNE

SEQ ID NO: 14558 - protein, 13 aa, Mus sp.
LPDYSAPNPIKVT

SEQ ID NO: 14559 - protein, 13 aa, Mus sp.
GDIFIGPKAEEHR

SEQ ID NO: 14560 - protein, 15 aa, Mus sp.
LPTYDASKVTASGPG

SEQ ID NO: 14561 - protein, 16 aa, Mus sp.
EVKAFFESHPAPSAER

SEQ ID NO: 14562 - protein, 15 aa, Mus sp.
FDQGYEAPGVREAAA

SEQ ID NO: 14563 - protein, 15 aa, Mus sp.
KLQMEAPHIIVGTPG

SEQ ID NO: 14564 - protein, 16 aa, Mus sp.
LSLLYKVPYVAQEIQE

SEQ ID NO: 14565 - protein, 15 aa, Mus sp.
VGTARYMAPEVLESR

SEQ ID NO: 14566 - protein, 16 aa, Mus sp.
GPVPEFSGATVERVSE

SEQ ID NO: 14567 - protein, 15 aa, Mus sp.
TENGYSYPVVSYWVD

SEQ ID NO: 14568 - protein, 14 aa, Mus sp.
EAGQSKGFGLICFF

SEQ ID NO: 14569 - protein, 14 aa, Mus sp.
RDYVPPTANLDQKD

SEQ ID NO: 14570 - protein, 15 aa, Mus sp.
FVHFFAPQGLPVVPK

SEQ ID NO: 14571 - protein, 19 aa, Mus sp.
AAPAPAAAPAAAPAAAPEP

SEQ ID NO: 14572 - protein, 18 aa, Mus sp.
KPGSDTIKPDVNKSKEYF

SEQ ID NO: 14573 - protein, 18 aa, Mus sp.
DEGERYIAPTVLVDVQET

SEQ ID NO: 14574 - protein, 14 aa, Mus sp.
GDSNFGAPSASVAA

SEQ ID NO: 14575 - protein, 20 aa, Mus sp.
MEKEDRRYNPPIIHQGFQDT

SEQ ID NO: 14576 - protein, 16 aa, Mus sp.
DWLRYSPAYAHLVAPG

SEQ ID NO: 14577 - protein, 15 aa, Mus sp.
NDLQYAAPGGLIGVG

SEQ ID NO: 14578 - protein, 16 aa, Mus sp.
SSVAFIKPGVNKAEVT

SEQ ID NO: 14579 - protein, 15 aa, Mus sp.
APVPSPVAPAPVPSR

SEQ ID NO: 14580 - protein, 23 aa, Mus sp.
PPGFEDYVELPPSVSQAATSPPG

SEQ ID NO: 14581 - protein, 13 aa, Mus sp.
YPYIPAHITKPKE

SEQ ID NO: 14582 - protein, 12 aa, Mus sp.
WKYEKPDGSPVF

SEQ ID NO: 14583 - protein, 16 aa, Mus sp.
NSTDGGSFCHVKASPI

SEQ ID NO: 14584 - protein, 15 aa, Mus sp.
MYPTGAPGAQAAPQA

SEQ ID NO: 14585 - protein, 14 aa, Mus sp.
LDKDSFSDPYAHVS

SEQ ID NO: 14586 - protein, 15 aa, Mus sp.
ELVRAPTAALSPEPQ

SEQ ID NO: 14587 - protein, 14 aa, Mus sp.
FETFNTPAMYVAIQ

SEQ ID NO: 14588 - protein, 17 aa, Mus sp.
DEGERYIAPTVLVDVQE

SEQ ID NO: 14589 - protein, 15 aa, Mus sp.
EGDIFIGPKAEEHRG

SEQ ID NO: 14590 - protein, 15 aa, Mus sp.
AEEYLGMPVANAVIS

SEQ ID NO: 14591 - protein, 13 aa, Mus sp.
NPSYNYEIVNRAS

SEQ ID NO: 14592 - protein, 14 aa, Mus sp.
NLDWQYPGSRGSPP

SEQ ID NO: 14593 - protein, 16 aa, Mus sp.
FELKPRSPQVIPIEEF

SEQ ID NO: 14594 - protein, 15 aa, Mus sp.
TPYYVAPEVLGPEKY

SEQ ID NO: 14595 - protein, 13 aa, Mus sp.
IVYEGPELNHAFG

SEQ ID NO: 14596 - protein, 16 aa, Mus sp.
AVKSKYKASIAALEAK

SEQ ID NO: 14597 - protein, 13 aa, Mus sp.
DKEFHAPLIIDEN

SEQ ID NO: 14598 - protein, 17 aa, Mus sp.
GPKVDIEGPNVNIEGPE

SEQ ID NO: 14599 - protein, 17 aa, Mus sp.
DFVAWATGEPNFANDDE

SEQ ID NO: 14600 - protein, 17 aa, Mus sp.
VLVFDVTAPNTFKTLDS

SEQ ID NO: 14601 - protein, 16 aa, Mus sp.
DKRLEFEASQVLGTMD

SEQ ID NO: 14602 - protein, 15 aa, Mus sp.
TKRYMAPEVLDDSIN

SEQ ID NO: 14603 - protein, 16 aa, Mus sp.
ESKATYSTNSPVWEEA

SEQ ID NO: 14604 - protein, 17 aa, Mus sp.
SAPPHFHFGQTNRTPEF

SEQ ID NO: 14605 - protein, 17 aa, Mus sp.
EVKDYEPPFGSKVREHP

SEQ ID NO: 14606 - protein, 25 aa, Mus sp.
VIPELNGKLTGMAFRVPTPNVSVVD

SEQ ID NO: 14607 - protein, 19 aa, Mus sp.
MTFCKSNVINHFYCADPPL

SEQ ID NO: 14608 - protein, 15 aa, Mus sp.
EKVIVDFSSPNIAKE

SEQ ID NO: 14609 - protein, 17 aa, Mus sp.
GPKVNVEAPNVNMEGLG

SEQ ID NO: 14610 - protein, 15 aa, Mus sp.
KQIVWNGPVGVFEWE

SEQ ID NO: 14611 - protein, 18 aa, Mus sp.
DPDGFSWPATLPSVYKQP

SEQ ID NO: 14612 - protein, 13 aa, Mus sp.
NSVFVAPAVTPVK

SEQ ID NO: 14613 - protein, 16 aa, Mus sp.
TVPIYEGYALPHAILR

SEQ ID NO: 14614 - protein, 8 aa, Mus sp.
VNIEFKDL

SEQ ID NO: 14615 - protein, 14 aa, Mus sp.
KGPAFVNPLIPENK

SEQ ID NO: 14616 - protein, 13 aa, Mus sp.
ASFKDPKISTSLP

SEQ ID NO: 14617 - protein, 11 aa, Mus sp.
PIITPVAQENQ

SEQ ID NO: 14618 - protein, 16 aa, Mus sp.
YVELPPSVSQAAKSPP

SEQ ID NO: 14619 - protein, 15 aa, Mus sp.
AGNAFKKADPQEAIN

SEQ ID NO: 14620 - protein, 16 aa, Mus sp.
KLQEFELPYVSVTSLR

SEQ ID NO: 14621 - protein, 14 aa, Mus sp.
GYTYTASAIKHVIT

SEQ ID NO: 14622 - protein, 18 aa, Mus sp.
SREQFSYVLPTVHSLEPS

SEQ ID NO: 14623 - protein, 12 aa, Mus sp.
VFVAPAVTPVKG

SEQ ID NO: 14624 - protein, 17 aa, Mus sp.
LERESKVVVPPLPGKAF

SEQ ID NO: 14625 - protein, 18 aa, Mus sp.
FNNQAYHSPATALAIVDN

SEQ ID NO: 14626 - protein, 16 aa, Mus sp.
EEVEHWFYPQENIIDT

SEQ ID NO: 14627 - protein, 16 aa, Mus sp.
SLQAFSNPSAGISVDV

SEQ ID NO: 14628 - protein, 17 aa, Mus sp.
GALLLNAPVVSITQGRN

SEQ ID NO: 14629 - protein, 15 aa, Mus sp.
IGDSNFGAPSASVAA

SEQ ID NO: 14630 - protein, 13 aa, Mus sp.
WWRSPEPGPSAPG

SEQ ID NO: 14631 - protein, 13 aa, Mus sp.
DAEYWNSQPEILE

SEQ ID NO: 14632 - protein, 14 aa, Mus sp.
ASVGAWTGPMGNWA

SEQ ID NO: 14633 - protein, 20 aa, Mus sp.
NQGTVIHFNNPKVQASLAAN

SEQ ID NO: 14634 - protein, 21 aa, BOVIN
SVVVGPSVVAVPLPLHRAHYD

SEQ ID NO: 14635 - protein, 19 aa, Mus sp.
GLDIYVWRGAQATLSNTTK

SEQ ID NO: 14636 - protein, 11 aa, Mus sp.
VLDFVTPTPLG

SEQ ID NO: 14637 - protein, 22 aa, Mus sp.
DPTPDPNTAYASYPSASVENYQ

SEQ ID NO: 14638 - protein, 17 aa, Mus sp.
GTPDYISPEVLKSQGGD

SEQ ID NO: 14639 - protein, 17 aa, Mus sp.
LPFGAYTNPFATPAQAQ

SEQ ID NO: 14640 - protein, 16 aa, Mus sp.
EGPYYVKPVATTAVEG

SEQ ID NO: 14641 - protein, 16 aa, Mus sp.
YTLWKEFFFSVPAGPP

SEQ ID NO: 14642 - protein, 17 aa, Mus sp.
HNLFEDNMALPSESVSS

SEQ ID NO: 14643 - protein, 14 aa, Mus sp.
LPNYSSPNALVLNT

SEQ ID NO: 14644 - protein, 20 aa, Mus sp.
ITVKELFTTPVLRASVSSPF

SEQ ID NO: 14645 - protein, 18 aa, Mus sp.
EPTSSSPYNPPDLEEAAK

SEQ ID NO: 14646 - protein, 17 aa, Mus sp.
APNLHFHNPNPEIPALL

SEQ ID NO: 14647 - protein, 15 aa, Mus sp.
KWKYEKPDGSPVFIA

SEQ ID NO: 14648 - protein, 8 aa, Mus sp.
HIYEFPQL

SEQ ID NO: 14649 - protein, 14 aa, Mus sp.
VDPYNNPVPRGLEA

SEQ ID NO: 14650 - protein, 17 aa, Mus sp.
ARQNFTEPTAIQAQGWP

SEQ ID NO: 14651 - protein, 14 aa, Mus sp.
LDWQYPGSRGSPPK

SEQ ID NO: 14652 - protein, 19 aa, Mus sp.
EPPQVPAEAPQPRASEDSP

SEQ ID NO: 14653 - protein, 13 aa, Mus sp.
GDSYRSPWSNKYD

SEQ ID NO: 14654 - protein, 15 aa, Mus sp.
EPPPAYEPPAPAPAP

SEQ ID NO: 14655 - protein, 20 aa, Mus sp.
KLTGMAFRVPTPNVSVVDLT

SEQ ID NO: 14656 - protein, 15 aa, Mus sp.
TEDNVFEAPTLVKVF

SEQ ID NO: 14657 - protein, 16 aa, Mus sp.
DSNFGAPSASVAAAPA

SEQ ID NO: 14658 - protein, 18 aa, Mus sp.
WSDAAAPFAGLSTDQTLR

SEQ ID NO: 14659 - protein, 17 aa, Mus sp.
APAAAEAPAAAEAPAPA

SEQ ID NO: 14660 - protein, 19 aa, Mus sp.
GSGNSTGFGEHGSSSHPLP

SEQ ID NO: 14661 - protein, 13 aa, Mus sp.
GPPIFNPVANEVY

SEQ ID NO: 14662 - protein, 16 aa, Mus sp.
YQMYGGPVVLVAHSMG

SEQ ID NO: 14663 - protein, 20 aa, Mus sp.
EPSPVSETVVTPEAAPEKNP

SEQ ID NO: 14664 - protein, 14 aa, Mus sp.
LVQTYVGAISNGSL

SEQ ID NO: 14665 - protein, 17 aa, Mus sp.
SIASFKDPKISTSLPVL

SEQ ID NO: 14666 - protein, 15 aa, Mus sp.
DSQYRASAPNSHVPL

SEQ ID NO: 14667 - protein, 14 aa, Mus sp.
VKDGYQMAQPVFAP

SEQ ID NO: 14668 - protein, 14 aa, Mus sp.
VQWNDPGAQYSLVN

SEQ ID NO: 14669 - protein, 20 aa, Mus sp.
RPPGPPPAPQPPSPAPSPPP

SEQ ID NO: 14670 - protein, 16 aa, Mus sp.
ITGVDFIGSTVGLAKV

SEQ ID NO: 14671 - protein, 17 aa, Mus sp.
LPDDINVYATTAANPKE

SEQ ID NO: 14672 - protein, 15 aa, Mus sp.
LDKDSFSDPYAHVSF

SEQ ID NO: 14673 - protein, 17 aa, Mus sp.
EPPQYPYIPAHITKPKE

SEQ ID NO: 14674 - protein, 17 aa, Mus sp.
EPIKSFEAPATINSASL

SEQ ID NO: 14675 - protein, 17 aa, Mus sp.
DPDSRGEYSWAVAQGVK

SEQ ID NO: 14676 - protein, 16 aa, Mus sp.
LSRFTSGVPSFVLDTE

SEQ ID NO: 14677 - protein, 17 aa, Mus sp.
LPETFRRPQIDPAVEGF

SEQ ID NO: 14678 - protein, 15 aa, Mus sp.
AAPASAPTPSTPAPT

SEQ ID NO: 14679 - protein, 17 aa, Mus sp.
AGEFDYSGSQAIKALKE

SEQ ID NO: 14680 - protein, 13 aa, Mus sp.
EFMGPEVAPALPD

SEQ ID NO: 14681 - protein, 15 aa, Mus sp.
AGMAVFTPVINGVGG

SEQ ID NO: 14682 - protein, 14 aa, Mus sp.
EVQWQSAEPGSTPR

SEQ ID NO: 14683 - protein, 18 aa, Mus sp.
VTTDHISPAGNIARNSPA

SEQ ID NO: 14684 - protein, 17 aa, Mus sp.
RPPADFTQPAAAAAAAA

SEQ ID NO: 14685 - protein, 16 aa, Mus sp.
EFDYSGSQAIKALKEE

SEQ ID NO: 14686 - protein, 14 aa, Mus sp.
TPEFLAPEVLTDTS

SEQ ID NO: 14687 - protein, 15 aa, Mus sp.
EEVNIKTAEAQLAYE

SEQ ID NO: 14688 - protein, 17 aa, Mus sp.
KEIEVDSSPSVLEILDT

SEQ ID NO: 14689 - protein, 15 aa, Mus sp.
GDPFAAPQVVPAFAS

SEQ ID NO: 14690 - protein, 16 aa, Mus sp.
KERASFITPVPGGVGP

SEQ ID NO: 14691 - protein, 14 aa, Mus sp.
VPVYLAGAAGLSVG

SEQ ID NO: 14692 - protein, 18 aa, Mus sp.
EQPGLNGAAAAAAAEAPD

SEQ ID NO: 14693 - protein, 18 aa, Mus sp.
DPKYRTWAWEAVEALESH

SEQ ID NO: 14694 - protein, 13 aa, Mus sp.
TSSYSNPTIGYEN

SEQ ID NO: 14695 - protein, 16 aa, Mus sp.
APDTRFVAPGALGNAP

SEQ ID NO: 14696 - protein, 14 aa, Mus sp.
QKTQYISPNLNPND

SEQ ID NO: 14697 - protein, 21 aa, Mus sp.
YPPPYPPAAFQGPSDHAAYPI

SEQ ID NO: 14698 - protein, 17 aa, Mus sp.
IDDVIYHEAAVRQAGAE

SEQ ID NO: 14699 - protein, 20 aa, Mus sp.
SSRAVYLSSKLRGVSLQTTG

SEQ ID NO: 14700 - protein, 19 aa, Mus sp.
DPSQKQNLLAPQNAVSSEE

SEQ ID NO: 14701 - protein, 16 aa, Mus sp.
RPVQFPYVTPAPHEPV

SEQ ID NO: 14702 - protein, 19 aa, Mus sp.
VGAGHFRSPHTTEVVGGAP

SEQ ID NO: 14703 - protein, 15 aa, Mus sp.
ADDIVGPVTHEIFEN

SEQ ID NO: 14704 - protein, 11 aa, Mus sp.
TPDYIAPEILQ

SEQ ID NO: 14705 - protein, 20 aa, Mus sp.
SANAIYSLAARPLPMPKLPP

SEQ ID NO: 14706 - protein, 13 aa, Mus sp.
GPVPWLGPQTDEA

SEQ ID NO: 14707 - protein, 15 aa, BOVIN
SVVVGPSVVAVPLPL

SEQ ID NO: 14708 - protein, 16 aa, Mus sp.
GFLSEIGSQALAAGSY

SEQ ID NO: 14709 - protein, 14 aa, Mus sp.
VNGKKFTAPHILIA

SEQ ID NO: 14710 - protein, 14 aa, Mus sp.
DLSQHATPLPTPAV

SEQ ID NO: 14711 - protein, 17 aa, Mus sp.
GEQKLFISPGLLPEAPT

SEQ ID NO: 14712 - protein, 18 aa, Mus sp.
NLRDNYRFAHTNIESLVK

SEQ ID NO: 14713 - protein, 14 aa, Mus sp.
AYNFDETKDLDLDD

SEQ ID NO: 14714 - protein, 18 aa, Mus sp.
LNVLRVINEPTAAALAYG

SEQ ID NO: 14715 - protein, 14 aa, Mus sp.
PPSYYTQPVPVPNA

SEQ ID NO: 14716 - protein, 18 aa, Mus sp.
ERLYLLAAPSAERSDWIQ

SEQ ID NO: 14717 - protein, 14 aa, Mus sp.
NVDPFKAVDTNRAS

SEQ ID NO: 14718 - protein, 17 aa, Mus sp.
DDDVNTYNAAIAYTIVS

SEQ ID NO: 14719 - protein, 21 aa, Mus sp.
DPAGPNFEYAEAPSRLSPDDA

SEQ ID NO: 14720 - protein, 18 aa, Mus sp.
NTHDLDFRAPHVLVLGSG

SEQ ID NO: 14721 - protein, 14 aa, Mus sp.
AVDVFFPPEAQNDF

SEQ ID NO: 14722 - protein, 12 aa, Mus sp.
GTPDYIAPEILQ

SEQ ID NO: 14723 - protein, 17 aa, Mus sp.
AGNFYVPAEPKLAFVIR

SEQ ID NO: 14724 - protein, 18 aa, Mus sp.
NHIEVWERPLSNLAWAVA

SEQ ID NO: 14725 - protein, 16 aa, Mus sp.
SFVNIVERDRTLGYQE

SEQ ID NO: 14726 - protein, 17 aa, Mus sp.
ADPSAFAAAAPAAAATT

SEQ ID NO: 14727 - protein, 15 aa, Mus sp.
LRDMYSKSSAAMSTY

SEQ ID NO: 14728 - protein, 15 aa, Mus sp.
TTTWQRPTAEYVRNY

SEQ ID NO: 14729 - protein, 13 aa, Mus sp.
VYHEPHIADAWPQ

SEQ ID NO: 14730 - protein, 14 aa, Mus sp.
EEWGPFKAPHANRF

SEQ ID NO: 14731 - protein, 19 aa, Mus sp.
GNRITPSYVAFTPEGERLI

SEQ ID NO: 14732 - protein, 17 aa, Mus sp.
LEEKGVYVQASTLGSLE

SEQ ID NO: 14733 - protein, 12 aa, Mus sp.
NELDYYDSPSVN

SEQ ID NO: 14734 - protein, 14 aa, Mus sp.
KQLTYTYPLVYDHK

SEQ ID NO: 14735 - protein, 23 aa, Mus sp.
GPPGFEDYVELPPSVSQAATSPP

SEQ ID NO: 14736 - protein, 16 aa, Mus sp.
GALAASAPVVAVAGLG

SEQ ID NO: 14737 - protein, 23 aa, Mus sp.
VPPAGGGDPEAPAPAPAAERPPA

SEQ ID NO: 14738 - protein, 17 aa, Mus sp.
AVKSKYKASIAALEAKI

SEQ ID NO: 14739 - protein, 15 aa, Mus sp.
LPENFRRPQTDQAVE

SEQ ID NO: 14740 - protein, 12 aa, Mus sp.
RYMAPEVLESRM

SEQ ID NO: 14741 - protein, 16 aa, Mus sp.
LPQDPTFHTPLDLYAY

SEQ ID NO: 14742 - protein, 18 aa, Mus sp.
KPGTTVEYLAPWANQIDM

SEQ ID NO: 14743 - protein, 14 aa, Mus sp.
KKNWFGPSPYVEVT

SEQ ID NO: 14744 - protein, 13 aa, Mus sp.
YLVYQEPIPTAQL

SEQ ID NO: 14745 - protein, 19 aa, Mus sp.
APLNVQFSSPLPGEAVKDL

SEQ ID NO: 14746 - protein, 13 aa, Mus sp.
LPAAAQAPDALPA

SEQ ID NO: 14747 - protein, 17 aa, Mus sp.
TVTPWKAPIVWEGTYDT

SEQ ID NO: 14748 - protein, 13 aa, Mus sp.
EVLAPQVVLSLGG

SEQ ID NO: 14749 - protein, 18 aa, Mus sp.
IFSPYFINGQQLHLSEDM

SEQ ID NO: 14750 - protein, 15 aa, Mus sp.
GTPEFLAPEVLTDTS

SEQ ID NO: 14751 - protein, 11 aa, Mus sp.
PKISTSLPVLD

SEQ ID NO: 14752 - protein, 16 aa, Mus sp.
DQENKYQASHPNLRRL

SEQ ID NO: 14753 - protein, 18 aa, Mus sp.
DSRTNTAYVGSAILSEET

SEQ ID NO: 14754 - protein, 16 aa, Mus sp.
LNLEYHSSMIADAVKK

SEQ ID NO: 14755 - protein, 16 aa, Mus sp.
YKRSNEFDYPSVGQLA

SEQ ID NO: 14756 - protein, 16 aa, Mus sp.
TPVFVHAGPFANIAHG

SEQ ID NO: 14757 - protein, 16 aa, Mus sp.
TSDIFGSPVTATAPLA

SEQ ID NO: 14758 - protein, 16 aa, Mus sp.
KPSGYNPPISILGILE

SEQ ID NO: 14759 - protein, 15 aa, Mus sp.
ATFGVSGGHINPAVS

SEQ ID NO: 14760 - protein, 12 aa, Listeria monocytogenes
EVVYHNMKQDLE

SEQ ID NO: 14761 - protein, 11 aa, Mus sp.
VFVAPAVTPVK

SEQ ID NO: 14762 - protein, 17 aa, Mus sp.
DYVELPPSVSQAAKSPP

SEQ ID NO: 14763 - protein, 13 aa, Mus sp.
NIYWTDSVPGSVS

SEQ ID NO: 14764 - protein, 18 aa, Mus sp.
VDVFYSSGIPATARPYRP

SEQ ID NO: 14765 - protein, 14 aa, Mus sp.
ANPDFTQPISEVVD

SEQ ID NO: 14766 - protein, 16 aa, Mus sp.
DEGERYIAPTVLVDVQ

SEQ ID NO: 14767 - protein, 23 aa, Listeria monocytogenes
AVDDTTVKFTLPTVAPAFENTIK

SEQ ID NO: 14768 - protein, 18 aa, Listeria monocytogenes
DDTTVKFTLPTVAPAFEN

SEQ ID NO: 14769 - protein, 18 aa, Listeria monocytogenes
GTKEKVVATPVSNVSTSS

SEQ ID NO: 14770 - protein, 18 aa, Listeria monocytogenes
EILLQKPNGERLTSFITL

SEQ ID NO: 14771 - protein, 21 aa, Listeria monocytogenes
ESVYLSAQKENPRLFAKIETF

SEQ ID NO: 14772 - protein, 26 aa, Listeria monocytogenes
ADFRYVFDTAKATAASSYPGSDETPP

SEQ ID NO: 14773 - protein, 19 aa, Listeria monocytogenes
DFRYVFDTAKATAASSYPG

SEQ ID NO: 14774 - protein, 33 aa, Listeria monocytogenes; identical to SEQ ID NO: 210

SEQ ID NO: 14775 - protein, 22 aa, Listeria monocytogenes
YVFDTAKATAASSYPGSDETPP

SEQ ID NO: 14776 - protein, 17 aa, Listeria monocytogenes
GINQAYTGSTALSDGLN

SEQ ID NO: 14777 - protein, 16 aa, Mus sp.
TVDVVLTPLVAEALDR

SEQ ID NO: 14778 - protein, 15 aa, Mus sp.
SMFLHINETYLLMEQ

SEQ ID NO: 14779 - protein, 16 aa, Mus sp.
FPDNYNSPTPYKIQYN

SEQ ID NO: 14780 - protein, 20 aa, Mus sp.
SPPHVQFTYQQPQPLSVEPR

SEQ ID NO: 14781 - protein, 13 aa, Mus sp.
TTDYNSPEAGNIF

SEQ ID NO: 14782 - protein, 12 aa, Mus sp.
IPFYTPIPNGLY

SEQ ID NO: 14783 - protein, 13 aa, Mus sp.
IPFYTPIPNGLYP

SEQ ID NO: 14784 - protein, 18 aa, Mus sp.
IHKSFVEVNEEGTEAAAA

SEQ ID NO: 14785 - protein, 17 aa, Mus sp.
TWSDAAAPFAGLSTDQT

SEQ ID NO: 14786 - protein, 18 aa, Mus sp.
TWSDAAAPFAGLSTDQTL

SEQ ID NO: 14787 - protein, 16 aa, Mus sp.
WSDAAAPFAGLSTDQT

SEQ ID NO: 14788 - protein, 18 aa, Mus sp.
YTWSDAAAPFAGLSTDQT

SEQ ID NO: 14789 - protein, 20 aa, Mus sp.
YTWSDAAAPFAGLSTDQTLR

SEQ ID NO: 14790 - protein, 15 aa, Mus sp.
AEQEVLAPQVVLSLG

SEQ ID NO: 14791 - protein, 14 aa, Mus sp.
IRYMAPEVLEGAVN

SEQ ID NO: 14792 - protein, 20 aa, Mus sp.
REPPPAYEPPAPAPAPLPPP

SEQ ID NO: 14793 - protein, 17 aa, Mus sp.
IGDSNFGAPSASVAAAP

SEQ ID NO: 14794 - protein, 18 aa, Mus sp.
IGDSNFGAPSASVAAAPA

SEQ ID NO: 14795 - protein, 15 aa, Mus sp.
SVGAWTGPMGNWAMF

SEQ ID NO: 14796 - protein, 15 aa, Mus sp.
LAWVAFPLALVSGTV

SEQ ID NO: 14797 - protein, 17 aa, Mus sp.
AQRAGYKAAIVHNVDSD

SEQ ID NO: 14798 - protein, 18 aa, Mus sp.
TPDPNTAYASYPSASVEN

SEQ ID NO: 14799 - protein, 23 aa, Mus sp.
TPDPNTAYASYPSASVENYQQPP

SEQ ID NO: 14800 - protein, 22 aa, Mus sp.
YVDPTPDPNTAYASYPSASVEN

SEQ ID NO: 14801 - protein, 15 aa, Mus sp.
DISNYGFPRSVQAID

SEQ ID NO: 14802 - protein, 17 aa, Mus sp.
DISNYGFPRSVQAIDAA

SEQ ID NO: 14803 - protein, 18 aa, Mus sp.
YPRDISNYGFPRSVQAID

SEQ ID NO: 14804 - protein, 14 aa, Mus sp.
RERYNFPNPNPFVE

SEQ ID NO: 14805 - protein, 14 aa, Mus sp.
DIRSDWTNPEINKA

SEQ ID NO: 14806 - protein, 13 aa, Mus sp.
IRSDWTNPEINKA

SEQ ID NO: 14807 - protein, 15 aa, Mus sp.
EQIYYAGPVNNPGLD

SEQ ID NO: 14808 - protein, 19 aa, Mus sp.
GEQIYYAGPVNNPGLDVPQ

SEQ ID NO: 14809 - protein, 14 aa, Mus sp.
QIYYAGPVNNPGLD

SEQ ID NO: 14810 - protein, 19 aa, Mus sp.
WGIDPYDQPNAIYIERHEP

SEQ ID NO: 14811 - protein, 17 aa, Mus sp.
DLSQHATPLPTPAVLPG

SEQ ID NO: 14812 - protein, 16 aa, Mus sp.
NLDYWTYPGSLTTPPL

SEQ ID NO: 14813 - protein, 16 aa, Mus sp.
YVTQFHPPHIEIQMLK

SEQ ID NO: 14814 - protein, 18 aa, Mus sp.
DFLKKWETPSQNTAQLDQ

SEQ ID NO: 14815 - protein, 15 aa, Mus sp.
NLDYVATSIHEAVTK

SEQ ID NO: 14816 - protein, 16 aa, Mus sp.
VEPYEVHNPVPLIVGS

SEQ ID NO: 14817 - protein, 17 aa, Mus sp.
VYIFYGASIASLSASHS

SEQ ID NO: 14818 - protein, 19 aa, Mus sp.
LQHGSLFLKTPKIVSSKDY

SEQ ID NO: 14819 - protein, 16 aa, Mus sp.
DNMFSGSKINYTENRA

SEQ ID NO: 14820 - protein, 18 aa, Mus sp.
LPEEVGEYRQPSGGSVPV

SEQ ID NO: 14821 - protein, 25 aa, Mus sp.
ANLMEKIQASVATNPIITPVAQENQ

SEQ ID NO: 14822 - protein, 17 aa, Mus sp.
ASVATNPIITPVAQENQ

SEQ ID NO: 14823 - protein, 16 aa, Mus sp.
ELEEQLGPVAEETRAR

SEQ ID NO: 14824 - protein, 17 aa, Mus sp.
SPTSPSYSPTSPNYSPT

SEQ ID NO: 14825 - protein, 17 aa, Mus sp.
TPSSPSYSPSSPSYSPT

SEQ ID NO: 14826 - protein, 16 aa, Mus sp.
AKQIVWNGPVGVFEWE

SEQ ID NO: 14827 - protein, 13 aa, Mus sp.
LPVKWMAPESIFD

SEQ ID NO: 14828 - protein, 17 aa, Mus sp.
FKQETLPSNSNESHDHM

SEQ ID NO: 14829 - protein, 19 aa, Mus sp.
DPAGPNFEYAEAPSRLSPD

SEQ ID NO: 14830 - protein, 22 aa, Mus sp.
LDPAGPNFEYAEAPSRLSPDDA

SEQ ID NO: 14831 - protein, 14 aa, Mus sp.
RSNEFDYPSVGQLA

SEQ ID NO: 14832 - protein, 19 aa, Mus sp.
EDDIEADHVGTYGISVYQS

SEQ ID NO: 14833 - protein, 16 aa, Mus sp.
GLEEPVLKHWEPEIPA

SEQ ID NO: 14834 - protein, 14 aa, Mus sp.
TPATNEAPQATVFP

SEQ ID NO: 14835 - protein, 13 aa, Mus sp.
AEYWNSQPEILER

SEQ ID NO: 14836 - protein, 16 aa, Mus sp.
GRPDAEYWNSQPEILE

SEQ ID NO: 14837 - protein, 16 aa, Mus sp.
APNLHFHNPNPEIPAL

SEQ ID NO: 14838 - protein, 17 aa, Mus sp.
SNLSYREPDPEDAVGGS

SEQ ID NO: 14839 - protein, 21 aa, Mus sp.
DQGNRITPSYVAFTPEGERLI

SEQ ID NO: 14840 - protein, 21 aa, Mus sp.
EDGELTYENVQVSPVPGGPPG

SEQ ID NO: 14841 - protein, 15 aa, Mus sp.
EEDTEYMTPTSRPVG

SEQ ID NO: 14842 - protein, 15 aa, Mus sp.
VPWNFHEPQPGQYEF

SEQ ID NO: 14843 - protein, 16 aa, Mus sp.
YVPWNFHEPQPGQYEF

SEQ ID NO: 14844 - protein, 15 aa, Mus sp.
LEEIYLFSLPIKESE

SEQ ID NO: 14845 - protein, 17 aa, Mus sp.
ITVKELFTTPVLRASVS

SEQ ID NO: 14846 - protein, 24 aa, Mus sp.
GPPGFEDYVELPPSVSQAATSPPG

SEQ ID NO: 14847 - protein, 24 aa, Mus sp.
GPPGFEDYVELPPSVSQAAKSPPG

SEQ ID NO: 14848 - protein, 13 aa, Mus sp.
EDRRYNPPIIHQG

SEQ ID NO: 14849 - protein, 20 aa, Mus sp.
EKEDRRYNPPIIHQGFQDTS

SEQ ID NO: 14850 - protein, 18 aa, Mus sp.
HGLELEEPPLVLAAANVV

SEQ ID NO: 14851 - protein, 13 aa, Mus sp.
TPDYIAPEILQGL

SEQ ID NO: 14852 - protein, 16 aa, Mus sp.
LRQPYYATRVNAADIE

SEQ ID NO: 14853 - protein, 15 aa, Mus sp.
GQLPDYTSPVVLPYS

SEQ ID NO: 14854 - protein, 12 aa, Mus sp.
DNIFLSPLSIST

SEQ ID NO: 14855 - protein, 13 aa, Mus sp.
DNIFLSPLSISTA

SEQ ID NO: 14856 - protein, 14 aa, Mus sp.
DNIFLSPLSISTAF

SEQ ID NO: 14857 - protein, 14 aa, Mus sp.
NHTLFHNPHVNPLP

SEQ ID NO: 14858 - protein, 15 aa, Mus sp.
NHTLFHNPHVNPLPT

SEQ ID NO: 14859 - protein, 14 aa, Mus sp.
SPAEYAGPEGSYFG

SEQ ID NO: 14860 - protein, 18 aa, Mus sp.
DEATRYLAPTILTDVDPN

SEQ ID NO: 14861 - protein, 17 aa, Mus sp.
NNQDFRGSAGAPSVENV

SEQ ID NO: 14862 - protein, 17 aa, Mus sp.
SPPGGDFSDPVTSATLG

SEQ ID NO: 14863 - protein, 16 aa, Mus sp.
NIPYFETSAKEAINVE

SEQ ID NO: 14864 - protein, 16 aa, Mus sp.
SFFWNVAPGAESAVAS

SEQ ID NO: 14865 - protein, 17 aa, Mus sp.
ARMAPYQGPDAAPGALD

SEQ ID NO: 14866 - protein, 14 aa, Mus sp.
GERFEAPEALFQPH

SEQ ID NO: 14867 - protein, 21 aa, Mus sp.
LVTYVPVTTFKNLQTVNVDEN

SEQ ID NO: 14868 - protein, 12 aa, Mus sp.
VTYVPVTTFKNL

SEQ ID NO: 14869 - protein, 20 aa, Mus sp.
VTYVPVTTFKNLQTVNVDEN

SEQ ID NO: 14870 - protein, 25 aa, Mus sp.
DAGTIAGLNVLRIINEPTAAAIAYG

SEQ ID NO: 14871 - protein, 16 aa, Mus sp.
MSTHFWGPVANWGLPI

SEQ ID NO: 14872 - protein, 16 aa, Mus sp.
VGINYQPPTVVPGGDL

SEQ ID NO: 14873 - protein, 15 aa, Mus sp.
TDLRFQSSAVMALQE

SEQ ID NO: 14874 - protein, 19 aa, Mus sp.
NPLNSVFVAPAVTPVKGVL

SEQ ID NO: 14875 - protein, 19 aa, Mus sp.
VGTPDYISPEVLKSQGGDG

SEQ ID NO: 14876 - protein, 20 aa, Mus sp.
EKPVPAAPVPSPVAPAPVPS

SEQ ID NO: 14877 - protein, 15 aa, Mus sp.
KPVPAAPVPSPVAPA

SEQ ID NO: 14878 - protein, 16 aa, Mus sp.
LFYLALPPTVYEAVTK

SEQ ID NO: 14879 - protein, 19 aa, Mus sp.
EDGDMRLVNGASANEGRVE

SEQ ID NO: 14880 - protein, 18 aa, Mus sp.
LPQDPTFHTPLDLYAYAR

SEQ ID NO: 14881 - protein, 15 aa, Mus sp.
TSSYSNPTIGYENRV

SEQ ID NO: 14882 - protein, 16 aa, Mus sp.
TTSSYSNPTIGYENRV

SEQ ID NO: 14883 - protein, 17 aa, Mus sp.
GIPVYRFVLPANAFASP

SEQ ID NO: 14884 - protein, 17 aa, Mus sp.
GTTVYRQFWIFDVQNPD

SEQ ID NO: 14885 - protein, 16 aa, Mus sp.
HTVSFVQPNGAIFEPS

SEQ ID NO: 14886 - protein, 14 aa, Mus sp.
GDLAIYAAAVPVSL

SEQ ID NO: 14887 - protein, 18 aa, Mus sp.
NPTDAYLDAMMNEAPGPI

SEQ ID NO: 14888 - protein, 15 aa, Mus sp.
KPSTFAYPAPLEVPK

SEQ ID NO: 14889 - protein, 13 aa, Mus sp.
SVSYLRECAKAND

SEQ ID NO: 14890 - protein, 15 aa, Mus sp.
INIYSASSVSEVNDG

SEQ ID NO: 14891 - protein, 21 aa, Mus sp.
YPNPTLDHYKEPSAIFQLPYE

SEQ ID NO: 14892 - protein, 28 aa, Mus sp.
EKWEETELDQLFSGPLPGRLPVNHRPFS

SEQ ID NO: 14893 - protein, 16 aa, Mus sp.
ELDQLFSGPLPGRLPV

SEQ ID NO: 14894 - protein, 14 aa, Mus sp.
SKNVFLSPMSISSA

SEQ ID NO: 14895 - protein, 18 aa, Mus sp.
VHKAFVEVNEEGTEAAAA

SEQ ID NO: 14896 - protein, 14 aa, Mus sp.
AGGHKLGLALELEA

SEQ ID NO: 14897 - protein, 17 aa, Mus sp.
RRTDWEAPTGQPSAPGP

SEQ ID NO: 14898 - protein, 16 aa, Mus sp.
RTDWEAPTGQPSAPGP

SEQ ID NO: 14899 - protein, 17 aa, Mus sp.
SLHLRFSAPQIENEPET

SEQ ID NO: 14900 - protein, 18 aa, Mus sp.
SSIASFKDPKISTSLPVL

SEQ ID NO: 14901 - protein, 19 aa, Mus sp.
SSIASFKDPKISTSLPVLD

SEQ ID NO: 14902 - protein, 18 aa, Mus sp.
GPRPEEYEFLTPVEEAPK

SEQ ID NO: 14903 - protein, 15 aa, Mus sp.
ARQNFTEPTAIQAQG

SEQ ID NO: 14904 - protein, 14 aa, Mus sp.
RQNFTEPTAIQAQG

SEQ ID NO: 14905 - protein, 16 aa, Mus sp.
VLRIINEPTAAAIAYG

SEQ ID NO: 14906 - protein, 16 aa, Mus sp.
TPSYYTTSDAVISTET

SEQ ID NO: 14907 - protein, 15 aa, Mus sp.
TARYMAPEVLESRMN

SEQ ID NO: 14908 - protein, 18 aa, Mus sp.
GPEPGPYAQPSVNTPLPN

SEQ ID NO: 14909 - protein, 8 aa, Mus sp.
SSFVFLNL

SEQ ID NO: 14910 - protein, 19 aa, Mus sp.
GKLTGMAFRVPTPNVSVVD

SEQ ID NO: 14911 - protein, 17 aa, Mus sp.
GMAFRVPTPNVSVVDLT

SEQ ID NO: 14912 - protein, 13 aa, Mus sp.
RYMAPEVLDDSIN

SEQ ID NO: 14913 - protein, 16 aa, Mus sp.
GCKVRDHMVVLHDQGE

SEQ ID NO: 14914 - protein, 15 aa, Mus sp.
KDSFSDPYAHVSFLH

SEQ ID NO: 14915 - protein, 16 aa, Mus sp.
EDPDGFSWPATLPSVY

SEQ ID NO: 14916 - protein, 14 aa, Mus sp.
INDYKGAVIVVSHD

SEQ ID NO: 14917 - protein, 16 aa, Mus sp.
APISSHTAPRPNPTPA

SEQ ID NO: 14918 - protein, 16 aa, Mus sp.
AIETIVAAMSNLVPPV

SEQ ID NO: 14919 - protein, 19 aa, Mus sp.
KGMKAFVSFVQAYAKHECS

SEQ ID NO: 14920 - protein, 16 aa, Mus sp.
IWRDYVPPTANLDQKD

SEQ ID NO: 14921 - protein, 20 aa, Mus sp.
MIPVWPFPYLSVGTMLKNLN

SEQ ID NO: 14922 - protein, 20 aa, Mus sp.
APETRSQVTPSVPSEALDDS

SEQ ID NO: 14923 - protein, 16 aa, Mus sp.
RSQVTPSVPSEALDDS

SEQ ID NO: 14924 - protein, 24 aa, Mus sp.
TPARAPETRSQVTPSVPSEALDDS

SEQ ID NO: 14925 - protein, 26 aa, Mus sp.
TPARAPETRSQVTPSVPSEALDDSTG

SEQ ID NO: 14926 - protein, 9 aa, Mus sp.
YMIDNIILL

SEQ ID NO: 14927 - protein, 19 aa, Mus sp.
APGPSHTVAAPQAAAAAAL

SEQ ID NO: 14928 - protein, 15 aa, Mus sp.
FVNYSNAVTLHLGNN

SEQ ID NO: 14929 - protein, 14 aa, Mus sp.
NERFRCPEAIFQPS

SEQ ID NO: 14930 - protein, 16 aa, Mus sp.
VPIYEGYALPHAILRL

SEQ ID NO: 14931 - protein, 16 aa, Mus sp.
GYPTAYPAAAPAYNPS

SEQ ID NO: 14932 - protein, 17 aa, Mus sp.
INPDNVATPIAASLGDL

SEQ ID NO: 14933 - protein, 16 aa, Mus sp.
GREVSSVEAPSVSPAR

SEQ ID NO: 14934 - protein, 16 aa, Mus sp.
SILWSQPLPSLPGGPP

SEQ ID NO: 14935 - protein, 16 aa, Mus sp.
GLPDYSAPNPIKVTHR

SEQ ID NO: 14936 - protein, 16 aa, Mus sp.
EVAQLISPVTTASMSG

SEQ ID NO: 14937 - protein, 23 aa, Mus sp.
DESGFPKPPSYNVATTLPSYDEA

SEQ ID NO: 14938 - protein, 24 aa, Mus sp.
DESGFPKPPSYNVATTLPSYDEAE

SEQ ID NO: 14939 - protein, 17 aa, Mus sp.
DGDSVVFAGPAGNSVET

SEQ ID NO: 14940 - protein, 16 aa, Mus sp.
SESSVSTPSASFEPDV

SEQ ID NO: 14941 - protein, 18 aa, Mus sp.
KPTVTVVSPLPNDSINPQ

SEQ ID NO: 14942 - protein, 20 aa, Mus sp.
KPTVTVVSPLPNDSINPQPS

SEQ ID NO: 14943 - protein, 9 aa, Mus sp.
NVEIDPEIQ

SEQ ID NO: 14944 - protein, 18 aa, Mus sp.
GTDRKIVYEGPELNHAFG

SEQ ID NO: 14945 - protein, 15 aa, Mus sp.
RKIVYEGPELNHAFG

SEQ ID NO: 14946 - protein, 17 aa, Mus sp.
WKALYTDPKSSETAAFV

SEQ ID NO: 14947 - protein, 15 aa, Mus sp.
ERASFITPVPGGVGP

SEQ ID NO: 14948 - protein, 16 aa, Mus sp.
EPYAHAAPESIPATFE

SEQ ID NO: 14949 - protein, 13 aa, Mus sp.
IILENYAYPGVLL

SEQ ID NO: 14950 - protein, 19 aa, Mus sp.
GPAGPGAVEGPNPASSPDA

SEQ ID NO: 14951 - protein, 20 aa, Mus sp.
SPPSTPDSASAPSTTPASPA

SEQ ID NO: 14952 - protein, 27 aa, Mus sp.
IPISKVKDVYVITDQIPVFVTMSQKND

SEQ ID NO: 14953 - protein, 18 aa, Mus sp.
GPRAEEYEFLTPMEEAPK

SEQ ID NO: 14954 - protein, 15 aa, Mus sp.
AKVELVPPTPAEIPT

SEQ ID NO: 14955 - protein, 16 aa, Mus sp.
APMYYRGAQAAIVVYD

SEQ ID NO: 14956 - protein, 15 aa, Mus sp.
GSPYIAAKINEAKDL

SEQ ID NO: 14957 - protein, 18 aa, Mus sp.
IPITYPTTAPEIAVPELD

SEQ ID NO: 14958 - protein, 15 aa, Mus sp.
STLIWAAPRLQSEVA

SEQ ID NO: 14959 - protein, 9 aa, Mus sp.
VILLPKDIE

SEQ ID NO: 14960 - protein, 14 aa, Mus sp.
VVIEVFTPVVQRIL

SEQ ID NO: 14961 - protein, 16 aa, Mus sp.
GPPPYHESLAGASQPP

SEQ ID NO: 14962 - protein, 19 aa, Mus sp.
QPTGPPPYHESLAGASQPP

SEQ ID NO: 14963 - protein, 16 aa, Mus sp.
AQAAMEEPVVQPSVVD

SEQ ID NO: 14964 - protein, 15 aa, Mus sp.
EVLDYSTPTTNGTPE

SEQ ID NO: 14965 - protein, 21 aa, Mus sp.
IGYREYSTGGNFQFNIISIDT

SEQ ID NO: 14966 - protein, 15 aa, Mus sp.
DIYVWRGAQATLSNT

SEQ ID NO: 14967 - protein, 16 aa, Mus sp.
LPEYANAEIVRTRDPE

SEQ ID NO: 14968 - protein, 22 aa, Mus sp.
GPDGKGMNPPSYYTQPVPVPNA

SEQ ID NO: 14969 - protein, 24 aa, Mus sp.
GPDGKGMNPPSYYTQPVPVPNANA

SEQ ID NO: 14970 - protein, 17 aa, Mus sp.
GPYQAAAGPSVVPTAPP

SEQ ID NO: 14971 - protein, 25 aa, Mus sp.
TGPDGKGMNPPSYYTQPVPVPNANA

SEQ ID NO: 14972 - protein, 8 aa, Mus sp.
SVYSFLFL

SEQ ID NO: 14973 - protein, 15 aa, Mus sp.
VLVLDFVTPTPLGTR

SEQ ID NO: 14974 - protein, 15 aa, Mus sp.
DHVDFSQPEPHTVLF

SEQ ID NO: 14975 - protein, 17 aa, Mus sp.
GYAVYETPTAHNGAKNP

SEQ ID NO: 14976 - protein, 15 aa, Mus sp.
TDKFWGPSGAESVIG

SEQ ID NO: 14977 - protein, 17 aa, Mus sp.
KGPAFVNPLIPENKEEE

SEQ ID NO: 14978 - protein, 14 aa, Mus sp.
IPTYTKPNPNQIIS

SEQ ID NO: 14979 - protein, 16 aa, Mus sp.
SLEDFYGSPIPSVSLK

SEQ ID NO: 14980 - protein, 13 aa, Listeria sp
WNEKYAQAYPNVS

SEQ ID NO: 14981 - protein, 16 aa, Listeria sp
WNEKYAQAYPNVSAKI

SEQ ID NO: 14982 - protein, 16 aa, Listeria sp
VERWNEKYAQAYPNVS

SEQ ID NO: 14983 - protein, 15 aa, Listeria sp
ERWNEKYAQAYPNVS

SEQ ID NO: 14984 - protein, 21 aa, Listeria sp
APGQETQHYYGLPVADSAIDR

SEQ ID NO: 14985 - protein, 20 aa, Listeria sp
VWTKPNKIEGAQKISALSTY

SEQ ID NO: 14986 - protein, 20 aa, Listeria sp
ADFRYVFDTAKATAASSYPG

SEQ ID NO: 14987 - protein, 26 aa, Listeria sp
ADFRYVFDTAKATAASSYPGSDETPP

SEQ ID NO: 14988 - protein, 25 aa, Listeria sp
DFRYVFDTAKATAASSYPGSDETPP

SEQ ID NO: 14989 - protein, 33 aa, Listeria sp; identical to SEQ ID NO: 210

SEQ ID NO: 14990 - protein, 22 aa, Listeria sp
YVFDTAKATAASSYPGSDETPP

SEQ ID NO: 14991 - protein, 23 aa, Listeria sp
RYVFDTAKATAASSYPGSDETPP

SEQ ID NO: 14992 - protein, 15 aa, Listeria sp
YPGSDETPPVVNPGE

SEQ ID NO: 14993 - protein, 21 aa, Listeria sp
SSYPGSDETPPVVNPGETNPP

SEQ ID NO: 14994 - protein, 17 aa, Listeria sp
YPGSDETPPVVNPGETN

SEQ ID NO: 14995 - protein, 16 aa, Listeria sp
EVEDLNQPLAAHVNYE

SEQ ID NO: 14996 - protein, 21 aa, Listeria sp
AVDDTTVKFTLPTVAPAFENT

SEQ ID NO: 14997 - protein, 20 aa, Listeria sp
VDDTTVKFTLPTVAPAFENT

SEQ ID NO: 14998 - protein, 19 aa, Listeria sp
DDTTVKFTLPTVAPAFENT

SEQ ID NO: 14999 - protein, 23 aa, Listeria sp
AVDDTTVKFTLPTVAPAFENTIK

SEQ ID NO: 15000 - protein, 18 aa, Listeria sp
VDDTTVKFTLPTVAPAFE

SEQ ID NO: 15001 - protein, 17 aa, Listeria sp
DDTTVKFTLPTVAPAFE

SEQ ID NO: 15002 - protein, 18 aa, Listeria sp
DDTTVKFTLPTVAPAFEN

SEQ ID NO: 15003 - protein, 17 aa, Listeria sp
TTVKFTLPTVAPAFENT

SEQ ID NO: 15004 - protein, 16 aa, Listeria sp
DGLTWHDGKPLTADDV

SEQ ID NO: 15005 - protein, 19 aa, Listeria sp
GTKEKVVATPVSNVSTSSA

SEQ ID NO: 15006 - protein, 17 aa, Listeria sp
TKEKVVATPVSNVSTSS

SEQ ID NO: 15007 - protein, 16 aa, Listeria sp
KEKVVATPVSNVSTSS

SEQ ID NO: 15008 - protein, 16 aa, Listeria sp
GTKEKVVATPVSNVST

SEQ ID NO: 15009 - protein, 18 aa, Listeria sp
GGINQAYTGSTALSDGLN

SEQ ID NO: 15010 - protein, 15 aa, Listeria sp
GINQAYTGSTALSDG

SEQ ID NO: 15011 - protein, 16 aa, Listeria sp
GGINQAYTGSTALSDG

SEQ ID NO: 15012 - protein, 21 aa, Listeria sp
STVVVEAGDTLWGIAQSKGTT

SEQ ID NO: 15013 - protein, 14 aa, Listeria sp
IAVTAFAAPTIASA

SEQ ID NO: 15014 - protein, 23 aa, Listeria sp
VETKADIDALSLLSDKIFVTNQT

SEQ ID NO: 15015 - protein, 18 aa, Listeria sp
EAKELVDNAPKALKEGIA

SEQ ID NO: 15016 - protein, 19 aa, Listeria sp
SNVNHVLDIGYGGGSNVKN

SEQ ID NO: 15017 - protein, 12 aa, Listeria sp
EVVYHNMKQDLE

SEQ ID NO: 15018 - protein, 34 aa, Listeria sp; identical to SEQ ID NO: 591

SEQ ID NO: 15019 - protein, 18 aa, Listeria sp
EILLQKPNGERLTSFITL

SEQ ID NO: 15020 - protein, 18 aa, Listeria sp
GLLMAKKYKMNLTIVIVN

SEQ ID NO: 15021 - protein, 19 aa, Listeria sp
TVRAKSKTYPVYINEFALE

SEQ ID NO: 15022 - protein, 18 aa, Listeria sp
MNRVMLPLQQMGAKMHGK

SEQ ID NO: 15023 - protein, 22 aa, Listeria sp
VMASDYTRGLSIRAIELVFENL

SEQ ID NO: 15024 - protein, 15 aa, Listeria sp
YMEKHSVSRLVGAPP

SEQ ID NO: 15025 - protein, 31 aa, Listeria sp; identical to SEQ ID NO: 420

SEQ ID NO: 15026 - protein, 21 aa, Listeria sp
ESVYLSAQKENPRLFAKIETF

SEQ ID NO: 15027 - protein, 22 aa, Listeria sp
RDNYLFQLYEATGTPIHPMSPF

SEQ ID NO: 15028 - protein, 19 aa, Listeria sp
ERWNEKYAQAYPNVSAKID

SEQ ID NO: 15029 - protein, 20 aa, Listeria sp
ETQHYYGLPVADSAIDRGPL

SEQ ID NO: 15030 - protein, 19 aa, Listeria sp
FRYVFDTAKATAASSYPGS

SEQ ID NO: 15031 - protein, 21 aa, Listeria sp
DTTVKFTLPTVAPAFENTIKT

SEQ ID NO: 15032 - protein, 19 aa, Listeria sp
EKVVATPVSNVSTSSATSS

SEQ ID NO: 15033 - protein, 18 aa, Listeria sp
INQAYTGSTALSDGLNKM

SEQ ID NO: 15034 - protein, 20 aa, Listeria sp
GIAVTAFAAPTIASASTVVV

SEQ ID NO: 15035 - protein, 17 aa, Listeria sp
AKELVDNAPKALKEGIA

SEQ ID NO: 15036 - protein, 20 aa, Listeria sp
TVRAKSKTYPVYINEFALED

SEQ ID NO: 15037 - protein, 16 aa, Listeria sp
YHGPIFLNASLSGVLE

SEQ ID NO: 15038 - protein, 18 aa, Listeria sp
FGTHNVSSLSSGALNVHA

SEQ ID NO: 15039 - protein, 17 aa, Listeria sp
ANGDLYNAETSQYLGRL

SEQ ID NO: 15040 - protein, 14 aa, Listeria sp
YELPKLPYTYDALE

SEQ ID NO: 15041 - protein, 19 aa, Listeria sp
YIKKYDGDLKLALAAYNAG

SEQ ID NO: 15042 - protein, 17 aa, Listeria sp
FLITMAPEFPYLKPGSA

SEQ ID NO: 15043 - protein, 13 aa, Listeria sp
PKSTVSSATSTAQ

SEQ ID NO: 15044 - protein, 13 aa, Listeria sp
YPYVFGGSSPSTS

SEQ ID NO: 15045 - protein, 14 aa, Artificial Sequence
  Synthetic
ANCQGILMFPSTWY

SEQ ID NO: 15046 - protein, 13 aa, Artificial Sequence
  Synthetic
  MISC_FEATURE (4)..(4): Xaa = isoleucine or leucine
  MISC_FEATURE (9)..(9): Xaa = selenocysteine
VVKXARTYXKLSS

SEQ ID NO: 15047 - protein, 15 aa, Artificial Sequence
  Synthetic
  MISC_FEATURE (3)..(3): Xaa = isoleucine or leucine
  MISC_FEATURE (4)..(4): Xaa = selenocystein
  MISC_FEATURE (15)..(15): Xaa = isoleucine or leucine
FHXXRYTSEAAWQKX

SEQ ID NO: 15048 - protein, 17 aa, Artificial Sequence
  Synthetic
YVVHQKSSADDESWVYY

SEQ ID NO: 15049 - protein, 15 aa, Mus musculus
RTDWEAPTGQPSAPG

SEQ ID NO: 15050 - protein, 18 aa, Mus musculus
RPGLSYHYAHSHLAEEEG

SEQ ID NO: 15051 - protein, 15 aa, Mus musculus
NHTLFHNPHVNPLPT

SEQ ID NO: 15052 - protein, 30 aa, Mus musculus; identical to SEQ ID NO: 3326

SEQ ID NO: 15053 - protein, 15 aa, Mus musculus
DQKFYNFVVIHARAD

SEQ ID NO: 15054 - protein, 18 aa, Mus musculus
EKTGQEYKPGNPSAAAVQ

SEQ ID NO: 15055 - protein, 15 aa, Mus musculus
SKQEYDESGPSIVHR

SEQ ID NO: 15056 - protein, 16 aa, Mus musculus
LRDNYRFAHTNIESLV

SEQ ID NO: 15057 - protein, 16 aa, Mus musculus
FSFGKINPHYTVKGLE

SEQ ID NO: 15058 - protein, 18 aa, Mus musculus
DGIHHWTPPKGHVDPGEN

SEQ ID NO: 15059 - protein, 17 aa, Mus musculus
GNHTLFHNPHVNPLPTG

SEQ ID NO: 15060 - protein, 14 aa, Mus musculus
GDIEHPRAIALDPR

SEQ ID NO: 15061 - protein, 15 aa, Mus musculus
NLKHVAGAAAAGAVV

SEQ ID NO: 15062 - protein, 19 aa, Mus musculus
DGREVSSVEAPSVSPARHQ

SEQ ID NO: 15063 - protein, 15 aa, Mus musculus
KGQDHVDFSQPEPHT

SEQ ID NO: 15064 - protein, 11 aa, Mus musculus
RYMAPEVLESR

SEQ ID NO: 15065 - protein, 12 aa, Mus musculus
IEVAPPKAHEVR

SEQ ID NO: 15066 - protein, 14 aa, Mus musculus
RKIVYEGPELNHAF

SEQ ID NO: 15067 - protein, 12 aa, Mus musculus
RQTTQYPEANAL

SEQ ID NO: 15068 - protein, 18 aa, Mus musculus
EAIETIVAAMSNLVPPVE

SEQ ID NO: 15069 - protein, 12 aa, Mus musculus
EDRRYNPPIIHQ

SEQ ID NO: 15070 - protein, 21 aa, Mus musculus
GIKADKADKAAASGPASASAP

SEQ ID NO: 15071 - protein, 15 aa, Mus musculus
FVNYSNAVTLHLGNN

SEQ ID NO: 15072 - protein, 19 aa, Mus musculus
EMEKEDRRYNPPIIHQGFQ

SEQ ID NO: 15073 - protein, 16 aa, Mus musculus
EPRVLPYHPAQPGQAT

SEQ ID NO: 15074 - protein, 18 aa, Mus musculus
GRRTDWEAPTGQPSAPGP

SEQ ID NO: 15075 - protein, 23 aa, Artificial Sequence
  Synthetic
DKNGNPLNSVFVAPAVTPVKGVL

SEQ ID NO: 15076 - protein, 15 aa, Mus musculus
GDLEYQMSTTARAKR

SEQ ID NO: 15077 - protein, 17 aa, Mus musculus
ATPRDYYFALAHTVRDH

SEQ ID NO: 15078 - protein, 17 aa, Mus musculus
SSIASFKDPKISTSLPV

SEQ ID NO: 15079 - protein, 18 aa, Mus musculus
LPQDPTFHTPLDLYAYAR

SEQ ID NO: 15080 - protein, 16 aa, Mus musculus
DVDFDFAGPAIHGSAV

SEQ ID NO: 15081 - protein, 16 aa, Mus musculus
GYPTAYPAAAPAYNPS

SEQ ID NO: 15082 - protein, 17 aa, Mus musculus
DSPDVVYSPETIEARYE

SEQ ID NO: 15083 - protein, 18 aa, Mus musculus
TPDPNTAYASYPSASVEN

SEQ ID NO: 15084 - protein, 17 aa, Mus musculus
ESPDQWSSSSPHSASDW

SEQ ID NO: 15085 - protein, 15 aa, Mus musculus
VDFDFAGPAIHGSAV

SEQ ID NO: 15086 - protein, 20 aa, Mus musculus
DPTPDPNTAYASYPSASVEN

SEQ ID NO: 15087 - protein, 17 aa, Mus musculus
KLLEAKGPVTDVAYSHD

SEQ ID NO: 15088 - protein, 16 aa, Mus musculus
APVEGASPTSISAVDG

SEQ ID NO: 15089 - protein, 16 aa, Mus musculus
KKELEEQLGPVAEETR

SEQ ID NO: 15090 - protein, 6 aa, Mus musculus
LVEKIF

SEQ ID NO: 15091 - protein, 16 aa, Mus musculus
SSVAFIKPGVNKAEVT

SEQ ID NO: 15092 - protein, 16 aa, Mus musculus
SPDQWSSSSPHSASDW

SEQ ID NO: 15093 - protein, 19 aa, Mus musculus
APETRSQVTPSVPSEALDD

SEQ ID NO: 15094 - protein, 19 aa, Mus musculus
YNIPFTEKNILYSAFLWRT

SEQ ID NO: 15095 - protein, 19 aa, Mus musculus
SPESPDQWSSSSPHSASDW

SEQ ID NO: 15096 - protein, 21 aa, Mus musculus
TPSPESPDQWSSSSPHSASDW

SEQ ID NO: 15097 - protein, 16 aa, Mus musculus
DGDSYRSPWSNKYDPP

SEQ ID NO: 15098 - protein, 16 aa, Mus musculus
IGNERFRCPEAIFQPS

SEQ ID NO: 15099 - protein, 17 aa, Mus musculus
DGDSYRSPWSNKYDPPL

SEQ ID NO: 15100 - protein, 15 aa, Mus musculus
RKIVYEGPELNHAFG

SEQ ID NO: 15101 - protein, 15 aa, Mus musculus
CASSQESGASYEQYF

SEQ ID NO: 15102 - protein, 15 aa, Mus musculus
CASSQEQGGAETLYF

SEQ ID NO: 15103 - protein, 16 aa, Mus musculus
CASSQEGWGSAETLYF

SEQ ID NO: 15104 - protein, 15 aa, Mus musculus
CASSPRQGNTGQLYF

SEQ ID NO: 15105 - protein, 13 aa, Mus musculus
CASSPQGNTEVFF

SEQ ID NO: 15106 - protein, 15 aa, Mus musculus
CASSPPGQSNERLFF

SEQ ID NO: 15107 - protein, 15 aa, Mus musculus
CASSPGQGAGNTLYF

SEQ ID NO: 15108 - protein, 14 aa, Mus musculus
CASSLVGYNSPLYF

SEQ ID NO: 15109 - protein, 13 aa, Mus musculus
CASSLYSAETLYF

SEQ ID NO: 15110 - protein, 13 aa, Mus musculus
CASSLSQGYEQYF

SEQ ID NO: 15111 - protein, 14 aa, Mus musculus
CASSLLGSAETLYF

SEQ ID NO: 15112 - protein, 14 aa, Mus musculus
CASSLIPSSIEQYF

SEQ ID NO: 15113 - protein, 13 aa, Mus musculus
CASSLGSQNTLYF

SEQ ID NO: 15114 - protein, 15 aa, Mus musculus
CASSLGQGSVSDYTF

SEQ ID NO: 15115 - protein, 13 aa, Mus musculus
CASSLGQGQAPLF

SEQ ID NO: 15116 - protein, 15 aa, Mus musculus
CASSLGGGGAETLYF

SEQ ID NO: 15117 - protein, 12 aa, Mus musculus
CASSLGGAEQFF

SEQ ID NO: 15118 - protein, 13 aa, Mus musculus
CASSLEGTGQLYF

SEQ ID NO: 15119 - protein, 13 aa, Mus musculus
CASSLEGGREQYF

SEQ ID NO: 15120 - protein, 11 aa, Mus musculus
CASSLDSDYTF

SEQ ID NO: 15121 - protein, 14 aa, Mus musculus
CASSLDNSGNTLYF

SEQ ID NO: 15122 - protein, 12 aa, Mus musculus
CASSIQNTEVFF

SEQ ID NO: 15123 - protein, 13 aa, Mus musculus
CASSGDNQDTQYF

SEQ ID NO: 15124 - protein, 12 aa, Mus musculus
CASSFKGGTLYF

SEQ ID NO: 15125 - protein, 13 aa, Mus musculus
CASSDLGEDTQYF

SEQ ID NO: 15126 - protein, 14 aa, Mus musculus
CASSDGTSSYEQYF

SEQ ID NO: 15127 - protein, 13 aa, Mus musculus
CASSDGHNTEVFF

SEQ ID NO: 15128 - protein, 12 aa, Mus musculus
CASRTGAETLYF

SEQ ID NO: 15129 - protein, 13 aa, Mus musculus
CASGTTSAETLYF

SEQ ID NO: 15130 - protein, 16 aa, Mus musculus
CASGEGQGGRGNTLYF

SEQ ID NO: 15131 - protein, 13 aa, Mus musculus
CASGDPGQGEQYF

SEQ ID NO: 15132 - protein, 14 aa, Mus musculus
CASGDGGGAYEQYF

SEQ ID NO: 15133 - protein, 14 aa, Mus musculus
CASGDAREGDTQYF

SEQ ID NO: 15134 - protein, 11 aa, Mus musculus
CASEGQNTLYF

SEQ ID NO: 15135 - protein, 13 aa, Mus musculus
CAPSMSNYNVLYF

SEQ ID NO: 15136 - protein, 13 aa, Mus musculus
CAMEAGTGSKLSF

SEQ ID NO: 15137 - protein, 15 aa, Mus musculus
CAMDLMNYNQGKLIF

SEQ ID NO: 15138 - protein, 13 aa, Mus musculus
CALSTNSNNRIFF

SEQ ID NO: 15139 - protein, 13 aa, Mus musculus
CALSGQEGRALIF

SEQ ID NO: 15140 - protein, 13 aa, Mus musculus
CALSESNYNVLYF

SEQ ID NO: 15141 - protein, 17 aa, Mus musculus
CALSELATGGLSGKLTF

SEQ ID NO: 15142 - protein, 12 aa, Mus musculus
CALNYNQGKLIF

SEQ ID NO: 15143 - protein, 15 aa, Mus musculus
CALGQNYNQGKKLIF

SEQ ID NO: 15144 - protein, 13 aa, Mus musculus
CALGNSAGNKLTF

SEQ ID NO: 15145 - protein, 12 aa, Mus musculus
CALGLSNYQLIW

SEQ ID NO: 15146 - protein, 17 aa, Mus musculus
CALGDQRYGSSGNKLIF

SEQ ID NO: 15147 - protein, 14 aa, Mus musculus
CALERQGTGSKLSF

SEQ ID NO: 15148 - protein, 16 aa, Mus musculus
CALEGYTGANTGKLTF

SEQ ID NO: 15149 - protein, 11 aa, Mus musculus
CAISAGNKLTF

SEQ ID NO: 15150 - protein, 14 aa, Mus musculus
CAIEKNTGNYKYVF

SEQ ID NO: 15151 - protein, 14 aa, Mus musculus
CAATVSSGSWQLIF

SEQ ID NO: 15152 - protein, 13 aa, Mus musculus
CAASTGSGGKLTW

SEQ ID NO: 15153 - protein, 14 aa, Mus musculus
CAASTGGLSGKLTF

SEQ ID NO: 15154 - protein, 13 aa, Mus musculus
CAASPYGNEKITF

SEQ ID NO: 15155 - protein, 14 aa, Artificial Sequence
  Synthetic
CAASPNSAGNKLTF

SEQ ID NO: 15156 - protein, 12 aa, Artificial Sequence
  Synthetic
CAASNMGYKLTF

SEQ ID NO: 15157 - protein, 13 aa, Artificial Sequence
  Synthetic
CAASLGTGSKLSF

SEQ ID NO: 15158 - protein, 12 aa, Artificial Sequence
  Synthetic
CAASKGNNAPRF

SEQ ID NO: 15159 - protein, 13 aa, Artificial Sequence
  Synthetic
CAASISSNNRIFF

SEQ ID NO: 15160 - protein, 13 aa, Mus musculus
CAASDTNTGKLTF

SEQ ID NO: 15161 - protein, 15 aa, Mus musculus
CAASASNYGNEKITF

SEQ ID NO: 15162 - protein, 12 aa, Mus musculus
CAASASNNRIFF

SEQ ID NO: 15163 - protein, 15 aa, Mus musculus
CAASASNNAGAKLTF

SEQ ID NO: 15164 - protein, 13 aa, Mus musculus
CAASANSNNRIFF

SEQ ID NO: 15165 - protein, 13 aa, Mus musculus
CAARSSGSWQLIF

SEQ ID NO: 15166 - protein, 13 aa, Mus musculus
CAARPGNTGKLIF

SEQ ID NO: 15167 - protein, 13 aa, Mus musculus
CAAINTNTGKLTF

SEQ ID NO: 15168 - protein, 12 aa, Artificial Sequence
  Synthetic
CAAGTGGYKVVF

SEQ ID NO: 15169 - protein, 12 aa, Mus musculus
CAAEDSNYQLIW

SEQ ID NO: 15170 - protein, 15 aa, Mus musculus
CVVGDRGSALGRLHF

SEQ ID NO: 15171 - protein, 14 aa, Mus musculus
CVLAASSGSWQLIF

SEQ ID NO: 15172 - protein, 11 aa, Mus musculus
CTCSVQDTQYF

SEQ ID NO: 15173 - protein, 12 aa, Mus musculus
CTCSVEEDTQYF

SEQ ID NO: 15174 - protein, 14 aa, Mus musculus
CTCSARQGHTEVFF

SEQ ID NO: 15175 - protein, 13 aa, Mus musculus
CTCSAGGQDTQYF

SEQ ID NO: 15176 - protein, 16 aa, Mus musculus
CTCSAAAGVNQDTQYF

SEQ ID NO: 15177 - protein, 11 aa, Mus musculus
CTCRGADTQYF

SEQ ID NO: 15178 - protein, 13 aa, Mus musculus
QVTYMSNYNVLYF

SEQ ID NO: 15179 - protein, 15 aa, Mus musculus
CGASRLGGGQDTQYF

SEQ ID NO: 15180 - protein, 12 aa, Mus musculus
CGARQSSYEQYF

SEQ ID NO: 15181 - protein, 13 aa, Mus musculus
CGARAGHNTEVFF

SEQ ID NO: 15182 - protein, 14 aa, Mus musculus
CAWSLQGGNERLFF

SEQ ID NO: 15183 - protein, 13 aa, Mus musculus
CAVYNNAGAKLTF

SEQ ID NO: 15184 - protein, 13 aa, Mus musculus
CAVTSSSFSKLVF

SEQ ID NO: 15185 - protein, 14 aa, Mus musculus
CAVSISNMGYKLTF

SEQ ID NO: 15186 - protein, 14 aa, Mus musculus
CAVSATGGNNKLTF

SEQ ID NO: 15187 - protein, 15 aa, Mus musculus
CAVSASGGSNYKLTF

SEQ ID NO: 15188 - protein, 13 aa, Mus musculus
CAVSAANNNAPRF

SEQ ID NO: 15189 - protein, 12 aa, Mus musculus
CAVEASRNRIFF

SEQ ID NO: 15190 - protein, 12 aa, Mus musculus
CAVDTNTGKLTF

SEQ ID NO: 15191 - protein, 13 aa, Mus musculus
CATDEANTGKLTF

SEQ ID NO: 15192 - protein, 14 aa, Mus musculus
CASSYRGANSDYTF

SEQ ID NO: 15193 - protein, 13 aa, Mus musculus
CASSSTENTEVFF

SEQ ID NO: 15194 - protein, 16 aa, Mus musculus
CASSSSPTGVQDTQYF

SEQ ID NO: 15195 - protein, 14 aa, Mus musculus
CASSRDRGRRAPLF

SEQ ID NO: 15196 - protein, 14 aa, Mus musculus
CASSQGLGRYEQYF

SEQ ID NO: 15197 - protein, 13 aa, Mus musculus
CASSQETGGEQYF

SEQ ID NO: 15198 - protein, 20 aa, Mus musculus
VDDTTVKFTLPTVAPAFENT

SEQ ID NO: 15199 - protein, 16 aa, Mus musculus
WNEKYAQAYPNVSAKI

SEQ ID NO: 15200 - protein, 17 aa, Mus musculus
ISQAVHAAHAEINEAGR

SEQ ID NO: 15201 - protein, 13 aa, Mus musculus
WNEKYAQAYPNVS

SEQ ID NO: 15202 - protein, 13 aa, Mus musculus
VKFTLPTVAPAFE

SEQ ID NO: 15203 - protein, 13 aa, Mus musculus
YVFDTAKATAASS

SEQ ID NO: 15204 - protein, 13 aa, Mus musculus
HYYGLPVADSAID

SEQ ID NO: 15205 - protein, 12 aa, Mus musculus
NEKYAQAYPNVS

SEQ ID NO: 15206 - protein, 14 aa, Mus musculus
VLKDASAAAIYGSR

SEQ ID NO: 15207 - protein, 9 aa, Mus musculus
LKDASAAAI

SEQ ID NO: 15208 - protein, 9 aa, Mus musculus
ASAAAIYGS

SEQ ID NO: 15209 - protein, 17 aa, Mus musculus
IEQAVHAAHAEINEAGR

SEQ ID NO: 15210 - protein, 17 aa, Mus musculus
IGQAVHAAHAEINEAGR

SEQ ID NO: 15211 - protein, 17 aa, Mus musculus
ILQAVHAAHAEINEAGR

SEQ ID NO: 15212 - protein, 17 aa, Mus musculus
IHQAVHAAHAEINEAGR

SEQ ID NO: 15213 - protein, 17 aa, Mus musculus
IIQAVHAAHAEINEAGR

SEQ ID NO: 15214 - protein, 17 aa, Mus musculus
IRQAVHAAHAEINEAGR

SEQ ID NO: 15215 - DNA, 51 bp, Mus musculus
  misc_feature (4)..(6): n is a, c, g, or t
  misc_feature (31)..(33): n is a, c, g, or t
atannncaagctgtccatgcagcacatgcannnatcaatgaagcaggcaga

SEQ ID NO: 15216 - protein, 17 aa, Mus musculus
  misc_feature (2)..(2): Xaa can be any naturally occurring amino acid
  misc_feature (11)..(11): Xaa can be any naturally occurring amino acid
IXQAVHAAHAXINEAGR

SEQ ID NO: 15217 - protein, 17 aa, Mus musculus
ISQAVHAAHAEINEAGR

SEQ ID NO: 15218 - protein, 9 aa, Mus musculus
AAHAEINEA

SEQ ID NO: 15219 - protein, 93 aa, Mus musculus
VDGVPITSGDAGTGSGASPSNSDAPIDFGNGASEINPEDVESVTVLKGPAATALYGSRAANGAIVITTKSGKAEKGVGVTLNSSITWEKAGYY

SEQ ID NO: 15220 - protein, 78 aa, Mus musculus
VDGIPYDGGLNSINPQDVQSISVLKDAASAALYGARGANGVILVTTKRGQAGPAKVTLEARWGANSRQVSDYETVDDI

SEQ ID NO: 15221 - protein, 69 aa, Mus musculus
VDGVEMNLARINANDIESVSILKDASAAAVYGAKASAGVILVTTKSGQEDAAPKISFDLKAGWMQSTVS

SEQ ID NO: 15222 - protein, 70 aa, Mus musculus
CDGMEVSLGQINPNDIESISVLKDASAAAIYGAKASSGVILITTKSGKDSDGKVNVSYNGRFGWRKNTTS

SEQ ID NO: 15223 - protein, 70 aa, Mus musculus
IDGAEGDKSRVNPNDVESISVIKDASAAAVYGARAAFGVILVTTKSGSEKDGKATVRYSGRVGWEEPTTS

SEQ ID NO: 15224 - protein, 69 aa, Mus musculus
VDGIPAESYPNINPSDIESIEVLKDASAAAIYGSRANSGVVIITTKSGKSGMTKIDVSGRIGFGKLAKD

SEQ ID NO: 15225 - protein, 71 aa, Mus musculus
IDGVMTRENPGTILNSNDVESIQVLKDAASASIYGAQAANGVIIITTKRAKKGECRVTFDATLTLQTYQSG

SEQ ID NO: 15226 - protein, 69 aa, Mus musculus
VDGTPVSDLDNVNPDDVASISVLKDAATASIYGARAAAGVILVTTKGAKEGDLSITYNGEFSLMHASSY

SEQ ID NO: 15227 - protein, 72 aa, Mus musculus
IDGVECALSQLSELPAADIESVSVLKDAASAAIYGVRAAMGVILVTTKRGQKSEKVSVNYQGSYTLQTPGTL

SEQ ID NO: 15228 - protein, 69 aa, Mus musculus
VDGMTGIAISDVNPQDIENISILKDAASSAIYGSRAANGVILITTRQGMESRPSVTYSGNISFETVAKR

SEQ ID NO: 15229 - protein, 87 aa, Mus musculus
VDGMPMRSGRSTGDTGAFGSAGATEPIADLNPDDIESLSVLTGAAAAALYGSEAANGAIVITTKKGEAGKTKITVGTNTEWNQAWIL

SEQ ID NO: 15230 - protein, 88 aa, Mus musculus
IDGIPMFDVNTGDEKGGTMAKQPGSSSVADINPDDIESMSVLSGPSAAALYGSAAASGVILITTKKGSEGRAKLTYSNTTQFHTAWMT

SEQ ID NO: 15231 - protein, 90 aa, Mus musculus
VDGIPMLDMSRAATQPEGVYEGAAQTGDPLSAINPDDIENISVLSGPSAAALYGSAAANGVVMITTKKGEEGQTRVTISNNTTFQRVAVM

SEQ ID NO: 15232 - protein, 89 aa, Mus musculus
IDGIPMPNLSDLDQPEDNFSGMGQSGDGASMINPEDIESMSVLSGAAASALYGSQASNGVILITTKKGNTNGLRVTYSNSTQFYRAMAT

SEQ ID NO: 15233 - protein, 40 aa, Mus musculus
  MISC_FEATURE (1)..(1): Xaa = valine or isoleucine
  MISC_FEATURE (5)..(5): Xaa = valine or isoleucine
  MISC_FEATURE (9)..(9): Xaa = valine or isoleucine
  MISC_FEATURE (14)..(14): Xaa = valine or isoleucine
  MISC_FEATURE (31)..(31): Xaa = valine or isoleucine
  MISC_FEATURE (33)..(33): Xaa = valine or isoleucine
XDGPXNPDXESISXLKDAAAAAYGRAANGVXLXTTKGGVT

SEQ ID NO: 15234 - protein, 14 aa, Mus musculus
VLKDASAAAIYGSR

What is claimed is:

1. A method of identifying one or more immunodominant epitopes, comprising:
   a) generating, using one or more processors, a set of candidate antigens from one or more input genome sequences, wherein the one or more input genome sequences is derived from a target pathogen, a commensal microorganism, or a diseased cell;
   b) generating, using the one or more processors, a ranked set of antigenic epitopes from the candidate antigens using a deep neural network, wherein the deep neural network is trained using a set of MHCII-presented peptides bound to antigen presenting cells, wherein the antigen presenting cells are dendritic cells;
   c) detecting whether one or more of the antigenic epitopes is present in a sample from a subject suffering from an infection, autoimmune disease, allergy, or cancer;
   d) formulating an immunological composition comprising one or more of the identified epitopes; and
   e) identifying one or more immunodominant epitopes by:
      i) administering the immunological composition to a first population of immune cells to allow expression of the one or more identified epitopes, and wherein the first population of immune cells comprise a detectable reporter gene;
      ii) expressing in a second population of CD4+ immune cells a TCRαβ library expressing TCRαβ pairs identified in a subject suffering from an infectious disease, autoimmunity, cancer or allergy;
      ii) incubating the first population of immune cells with the second population of immune cells;
      iv) sorting immune cells positive for the detectable reporter gene; and
      v) identifying peptides bound to MHCII in immune cells positive for the detectable reporter gene, wherein the peptides identified comprise the immunodominant epitopes.

2. The method of claim 1, wherein generating a set of candidate antigens from one or more input genome sequences comprises:
   predicting, by the processor, genes from an input genome sequence; and
   defining, by the processor, a set of candidate antigens from the set of predicted genes based on one or more of protein cellular location, transmembrane structure, and domain distribution, wherein defining, by the processor, a set of candidate antigens from the set of predicted genes, comprises one or more of:

a) selecting surface and secreted proteins;
b) masking intracellular regions and transmembrane domains of the surface and extracellular proteins;
c) excluding regions that are within domains of less than 30 amino acids;
d) excluding regions between a series of inaccessible domains; and
e) excluding inter-domain regions between a series of adjacent domains wherein the inter-domain regions are less than or equal to 20 amino acids.

3. The method of claim 2, further comprising masking up to 20 amino acids flanking the intracellular regions and transmembrane domains, wherein 8 amino acids flanking the intracellular regions and transmembrane domains are masked; and/or
   wherein the surface protein is a cell wall protein; or
   wherein the surface protein is an outer membrane protein.

4. The method of claim 1, wherein the antigenic epitopes are derived from candidate antigens more than 20 amino acids away from a transmembrane domain; and/or
   wherein the candidate antigens comprise a tertiary structure required for proteolytic enzyme accessibility; and/or
   wherein the candidate antigens comprise a defined MHCII-binding motif in the primary amino acid sequence of the predicted genes, such as, the I-Ab-binding motif; and/or
   wherein the antigenic epitopes comprise a tertiary structure required for accessibility to a MHCII binding groove; and/or
   wherein generating, by the processor, a ranked set of antigenic epitopes from the candidate antigens using a deep neural network comprises:
a) encoding each amino acid of an input candidate antigen into a p-dimensional binary vector;
b) converting the binary vector to a descriptor matrix S;
c) convoluting the descriptor matrix S to a scoring matrix X; and
d) transforming the scoring matrix X into a cl-dimensional vector Z, wherein vector Z is input for a neural network; and/or
   wherein the antigenic epitopes are specific for an HLA type; and/or
   wherein the candidate antigens are expressed in the pathogen, commensal microorganism or diseased cell; and/or
   wherein the one or more input genome sequences is obtained by whole genome or whole exome sequencing; and/or
   wherein the antigenic epitopes are about 9 to 20 amino acids in length.

5. The method of claim 1, wherein the method further comprises:
   a) isolating MHCII-peptide complexes from antigen presenting cells, wherein the antigen presenting cells are exposed to a target pathogen, commensal microorganism or diseased cell; wherein the antigen presenting cells are dendritic cells; and/or wherein the antigen presenting cell comprises a subject specific MHCII allele, wherein the antigen presenting cell comprises a human MHCII allele;
   b) identifying bound peptides from the MHCII-peptide complexes; and
   c) training the deep neural network using the set of identified peptides.

6. The method of claim 1, wherein the pathogen is selected from the group consisting of a bacterium, a virus, a protozoan, and an allergen, wherein the pathogen comprises a bacteria belonging to a family selected from the group consisting of *Bacillus*, *Bartonella*, *Bordetella*, *Borrelia*, *Brucella*, *Campylobacter*, *Chlamydia* and *Chlamydophila*, *Clostridium*, *Corynebacterium*, *Enterococcus*, *Escherichia*, *Francisella*, *Haemophilus*, *Helicobacter*, *Legionella*, *Leptospira*, *Listeria*, *Mycobacterium*, *Mycoplasma*, *Neisseria*, *Pseudomonas*, *Rickettsia*, *Salmonella*, *Shigella*, *Staphylococcus*, *Streptococcus*, *Treponema*, *Ureaplasma*, *Vibrio*, and *Yersinia*; or
   wherein the diseased cell is a cancer cell, wherein the cancer cell is obtained from a subject; or
   wherein the diseased cell is associated with an autoimmune disease; or
   wherein the commensal microorganism comprises a bacterium belonging to a genus selected from the group consisting of *Bacteroides*, *Clostridium*, *Faecalibacterium*, *Eubacterium*, *Ruminococcus*, *Peptococcus*, *Peptostreptococcus*, *Bifidobacterium*, *Lactobacillus* and *Akkermansia*; or a fungus selected from the group consisting of *Candida*, *Saccharomyces*, *Aspergillus*, *Penicillium*, *Rhodotorula*, *Trametes*, *Pleospora*, *Sclerotinia*, *Bullera*, and *Galactomyces*.

7. The method of claim 6, further comprising identifying non-silent tumor specific somatic mutations from the subject specific cancer cell, wherein the ranked set of antigenic epitopes are generated from said mutations.

8. The method of claim 1, wherein the deep neural network is trained using a set of MHCII-presented peptides comprising one or more of SEQ ID NOs: 1-14979; or
   wherein the deep neural network is trained using a set of MHCII-presented peptides comprising one or more of SEQ ID NOs: 14980-15027.

9. The method of claim 1, wherein the immunological composition is a protective vaccine or tolerizing vaccine composition comprising one or more of the antigenic epitopes,
   wherein the vaccine composition comprises autologous dendritic cells or antigen presenting cells pulsed with the one or more epitopes; or
      wherein the vaccine composition is directed to a bacterium, a virus or a protozoan; or
      wherein the vaccine composition is directed to a cancer; or
      wherein the vaccine composition is directed to an autoimmune disease or allergy, whereby administration of the vaccine induces tolerance to the one or more antigenic epitopes.

10. The method of claim 9, wherein the vaccine composition is directed to *Listeria*.

11. The method of claim 10, wherein the one or more *Listeria* peptides are derived from lmo0202, lmo2558, lmo2185, or lmo0135.

12. The method of claim 10, wherein the one or more *Listeria* peptides are selected from the group consisting of SEQ ID NO: 14981 (WNEKYAQAYPNVSAKI), SEQ ID NO: 14984 (APGQETQHYYGLPVADSAIDR), SEQ ID NO: 14986 (ADFRYVFDTAKATAASSYPG), and SEQ ID NO: 14997 (VDDTTVKFTLPTVAPAFENT).

13. The method of claim 1, wherein the method comprises determining immune related health status in a subject comprising:
   a) exposing the immunological composition comprising one or more peptides to immune cells obtained from the subject; and
   b) measuring cytokine secretion, wherein the cytokines measured comprise IL-2, IFN-y, IL-17, and/or IL-10.

14. The method of claim 13, further comprising measuring immune cell types reactive to the epitopes in the subject,
   wherein the immune cell types comprise Treg, Th1, Th17 and/or Th2 cells; and/or
   wherein the immune cells are measured using MHCII tetramers.

15. The method of claim 1, wherein the method comprises determining immune related health status in a subject comprising:
   measuring immune cell types reactive to the immunological composition comprising one or more of the identified epitopes in the subject,
   wherein the immune cell types comprise Treg, Th1, Th17 and/or Th2 cells; and/or
   wherein the immune cells are measured using MHCII tetramers.

16. The method of claim 1, wherein the TCRαβ pairs are identified by T cell profiling,
   wherein TCRαβ pairs are determined by targeted single cell RNA-seq (TCRseq); or
   wherein T cells are analyzed by RNA-seq to determine single cells having a specific cell state and TCRαβ pairs are identified in the T cells having a specific cell state, wherein the specific cell state is a pathogenic phenotype or a protective phenotype.

17. The method of claim 1, wherein the reporter is an inducible fluorescent marker protein, wherein the marker protein is induced when a TCRαβ pair detects an MHCII epitope, wherein the fluorescent marker is under control of the IL-2 promoter.

18. The method of claim 1, further comprising formulating a vaccine composition comprising one or more of the immunodominant epitopes,
   wherein the vaccine is a protective vaccine or a tolerizing vaccine; or
   wherein the vaccine comprises autologous dendritic cells or antigen presenting cells pulsed with one or more of the immunodominant epitopes.

* * * * *